US008828382B2

(12) United States Patent
Rothe et al.

(10) Patent No.: US 8,828,382 B2
(45) Date of Patent: Sep. 9, 2014

(54) HEPARIN-BINDING EPIDERMAL GROWTH FACTOR-LIKE GROWTH FACTOR BINDING PROTEINS

(75) Inventors: Mike Rothe, Krailling (DE); Norbert Prenzel, Krailling (DE); Eric Borges, Maria Enzersdorf (AT); Thore Hettmann, Munich (DE); Esther Zwick-Wallasch, Gauting (DE); Orit Foord, Foster City, CA (US)

(73) Assignees: U3 Pharma GmbH, Martinsried (DE); Amgen Inc., Thousand Oaks, CA (US)

( * ) Notice: Subject to any disclaimer, the term of this patent is extended or adjusted under 35 U.S.C. 154(b) by 540 days.

(21) Appl. No.: 12/680,191

(22) PCT Filed: Sep. 26, 2008

(86) PCT No.: PCT/EP2008/008233
§ 371 (c)(1),
(2), (4) Date: Jan. 13, 2011

(87) PCT Pub. No.: WO2009/040134
PCT Pub. Date: Apr. 2, 2009

(65) Prior Publication Data
US 2011/0110956 A1 May 12, 2011

Related U.S. Application Data

(60) Provisional application No. 60/975,485, filed on Sep. 26, 2007.

(30) Foreign Application Priority Data

Sep. 26, 2007 (EP) .................................... 07018946

(51) Int. Cl.
| A61K 39/395 | (2006.01) |
| C07K 16/22 | (2006.01) |
| C12P 21/08 | (2006.01) |
| C07H 21/04 | (2006.01) |

(52) U.S. Cl.
USPC .................. 424/130.1; 424/135.1; 424/141.1; 424/158.1; 536/23.53; 530/387.1; 530/387.3; 530/388.1; 530/388.24

(58) Field of Classification Search
CPC . C07K 16/22; A61K 39/395; A61K 39/3955; A61K 2039/505
See application file for complete search history.

(56) References Cited

U.S. PATENT DOCUMENTS

| 3,218,121 A | 11/1965 | Tufts |
| 3,773,919 A | 11/1973 | Boswell |
| 4,399,216 A | 8/1983 | Axel et al. |
| 4,485,045 A | 11/1984 | Regen |
| 4,544,545 A | 10/1985 | Ryan et al. |
| 4,740,461 A | 4/1988 | Kaufman |
| 4,912,040 A | 3/1990 | Kaufman et al. |
| 4,959,455 A | 9/1990 | Clark et al. |
| 5,545,806 A | 8/1996 | Lonberg et al. |
| 5,545,807 A | 8/1996 | Surani et al. |
| 5,569,825 A | 10/1996 | Lonberg |
| 5,591,669 A | 1/1997 | Krimpenfort et al. |
| 5,612,205 A | 3/1997 | Kay et al. |
| 5,625,126 A | 4/1997 | Lonberg et al. |
| 5,633,425 A | 5/1997 | Lonberg et al. |
| 5,643,763 A | 7/1997 | Dunn et al. |
| 5,661,016 A | 8/1997 | Lonberg et al. |
| 5,721,367 A | 2/1998 | Kay et al. |
| 5,770,429 A | 6/1998 | Lonberg et al. |
| 5,789,215 A | 8/1998 | Berns et al. |
| 5,789,650 A | 8/1998 | Lonberg et al. |
| 5,814,318 A | 9/1998 | Lonberg et al. |
| 5,874,299 A | 2/1999 | Lonberg et al. |
| 5,877,397 A | 3/1999 | Lonberg et al. |
| 5,939,598 A | 8/1999 | Kucherlapati et al. |
| 5,981,175 A | 11/1999 | Loring et al. |
| 6,023,010 A | 2/2000 | Krimpenfort et al. |
| 6,075,181 A | 6/2000 | Kucherlapati et al. |
| 6,114,598 A | 9/2000 | Kucherlapati et al. |
| 6,150,584 A | 11/2000 | Kucherlapati et al. |
| 6,162,963 A | 12/2000 | Kucherlapati et al. |
| 6,255,458 B1 | 7/2001 | Lonberg et al. |
| 6,673,986 B1 | 1/2004 | Kucherlapati et al. |
| 7,807,391 B2 * | 10/2010 | Shiotsuka et al. ........... 435/7.21 |
| 7,851,601 B2 * | 12/2010 | Mekada et al. .......... 530/388.24 |
| 7,973,140 B2 * | 7/2011 | Green et al. ............... 530/388.1 |
| 2003/0093820 A1 | 5/2003 | Green |

FOREIGN PATENT DOCUMENTS

| EP | 2 039 704 A1 | 3/2009 |
| EP | 2 078 731 A1 | 7/2009 |
| EP | 2 093 237 A1 | 8/2009 |

OTHER PUBLICATIONS

Cheng et al., Apr. 1, 2007, Biochemical Pharmacology 73:1001-1012.
Faull et al., 2001, Kidney International 59:614-624.
Itoh et al., 2005, Cytokine 29:275-282.
Mishima et al., Oct. 4, 1998, Acta Neuropathologica 96:322-328.
Miyamoto et al., May 2006, Cancer Science 97:341-347.
Abramovitch et al., 1998, FEBS letters 425:441-447.
Babcook et al., 1996, Proc. Natl. Acad. Sci. USA 93:7843-48.
Baldrick P., 2000, Pharmaceutical excipient development: the need for preclinical guidance, Regul. Toxicol. Pharmaco. 32:210-218.
Charman WN, Lypids, lipophilic drugs, and oral drug delivery-some emerging concepts, J. Pharm. Sci. 89-967-978.
Chothia et al., 1987, J. Mol. Biol. 196:901-917.
Chothia et al., 1989, Nature 342:877-883.
Clackson et al., 1991, Nature 352:624-628.
Davis-Fleischer et al., 1998, Front Biosci. 3:288-299.
Dhillon et al., 2007, Oncogene 26:3279-3290.
Eguchi et al., 2003, Biochem Soc Trans. Dec. 2003;31(Pt6):1198-1202.

(Continued)

Primary Examiner — Marianne P Allen
(74) Attorney, Agent, or Firm — Birgit Millaüer, Esq; Chao, Hadidi, Stark & Barker LLP

(57) ABSTRACT

Provided herein are antigen binding proteins, e.g., human and/or monoclonal antibodies that have affinity for heparin-binding epidermal growth factor-like growth factor (HB-EGF) and neutralize the biological functions of this growth factor.

10 Claims, 233 Drawing Sheets

(56) References Cited

OTHER PUBLICATIONS

Elenius et al., 1997, EMBO 16:1268-1278.
Epstein et al., 1985, Proc. Natl. Acad. Sci. USA 82:3688-3692.
Feldhaus et al., 2004, J. Immunol. Methods. 290:69-80.
Fischer et al. 2003, Biochem. Soc. Trans. 31:1203-1208.
Green et al., 1998, J. Exp. Med. 188:483-495.
Groves et al., 2005, Expert Opin Biol Ther. 5:125-135.
Heldin, 1995, Cell 80:213-223.
Higashiyama et al., 1992, J Biol Chem 267:6205-6212.
Hwang et al., 1980, Proc. Natl. Acad. Sci. USA 77:4030-4034.
Ishida et al., 2002, Cloning Stem Cells 4:91-102.
Iwamoto et al., 2000, Cytokine Growth Factor Rev. 11:335-344.
Jia et al., 2004, J. Immunol. Methods 288:91-98.
Jostock et al., 2005, Comb Chem High Throughput Screen. 8:127-133.
Kearney et al. 1979, J. Immunol. 123:1548-1550.
Langer et al., 1981, J. Biomed Mater. Res. 15:167-277.
Langer et al., 1982, Chem. Tech. 12:98-105.
Loukianov et al., 1997, Gene 195:81-86.
Maniatis et al., 1987, Science 236:1237.
Marks et al., 1991, J. Mol. Biol. 222:581-597.
Martin et al., 1996, J. Mol. Biol. 263:800-15.
Mendez et al., 1997, Nature Genetics 15:146-156.
Miyamoto, 2004, Cancer Res. 64:5720.
Ongusaha, 2004, Cancer Res. 64:5283-5290.
Powell et al, 1998, Compendium of excipients for parenteral formulations, PDA J. Pharm. Sci. Technol. 52:238-311.
Prenzel et al., 1999, Nature 402:884-888.
Prenzel et al., 2001, Endocr. Relat. Cancer 8:11-31.
Presta, 1992, Curr. Op. Struct. Biol. 2:593-596.
Saitou et al., 1987, Molecular Biology and Evolution 4:406-425.
Shah et al., Trends Pharmacol Sci. May 2003;24(5):239-244.
Sidman et al., 1983, Biopolymers 22:547-556.
Tanaka et al., 2005, Clin. Cancer Res. 11:4783-4792.
Thogersen et al., 2001, Cancer Res. 61:6227-6233.
Thompson et al., 1994, Nucleic Acids Res. 22:4673-4680.
Ullrich et al., 1990, Cell 61:203-212.
Voss et al., 1986 Trends Biochem. Sci. 11:287-289.
Wang, 2000, Lyophilization and development of solid protein pharmaceuticals, Int. J. Pharm. 203:1-60.
Wright et al., 1992, Br. J. Cancer 65:118-121.
Zushi et al., 1997, Int J Cancer 73:917-923;.
Davies et al., 1996, Immunotechnology 2:169-179.
Holt et al., 2003, Trends in Biotechnology 21:484-490.
Maynard et al., 2000, Annu. Rev. Biomed. Eng. 2:339-76.
Pini et al., 1998, The Journal of Biological Chemistry 273:21769-21776.
R&D Systems, 2011, Human HB-EGF Antibody Antigen Affinity-purified Polyclonal Goat IgG, Catalog No. AF-259-NA.
Schafer et al., 2004, The Journal of Biological Chemistry 279:47929-47938.
Tanaka et al., 2004, The Journal of Biological Chemistry 279:41950-41959.
Yahata et al., 2006, The Journal of Biological Chemistry 281:13209-13216.

* cited by examiner

U-V$_L$-1 light-chain variable region amino acid sequence (SEQ ID NO:94)
DVVMTQSPLSLPVTLGQPASISCRSSQSLVYSDGNTYLNWFQQRPGQSPRRLIYKVSNWDSGVPDRFNGSGSGTDFTLKISRVEAEDVG
                    CDR1                                CDR2

VYYCMQSTHWPITFGQGTRLEIK
   CDR3

U-V$_L$-2 light-chain variable region amino acid sequence (SEQ ID NO:95)
DVVMTQSPLSLPVTLGQPASISCRSSQSLVYSDGNTYLNWFQQRPGQSPRRLIYKVSNWDSGVPDRFSGSGSGTDFTLKISRVEAEDVG
                    CDR1                                CDR2

VYYCIQGTHWPTTFGQGTRLEIK
   CDR3

U-V$_L$-3 light-chain variable region amino acid sequence (SEQ ID NO:96)
DVVMTQSPLSLPVTLGQPASISCRSSQSLVYSDGNTYLNWLQQRPGQSPRRLIYKVSNWDSGVPDRFSGSGSGTDFTLKISRVEAEDVG
                    CDR1                                CDR2

VYYCMQGTHWPITFGQGTRLEIK
   CDR3

U-V$_L$-4 light-chain variable region amino acid sequence (SEQ ID NO:96)
DVVMTQSPLSLPVTLGQPASISCRSSQSLVYSDGNTYLNWLQQRPGQSPRRLIYKVSNWDSGVPDRFSGSGSGTDFTLKISRVEAEDVG
                    CDR1                                CDR2

VYYCMQGTHWPITFGQGTRLEIK
   CDR3

FIGURE 1A

U-V$_L$-5 light-chain variable region amino acid sequence (SEQ ID NO:97)
DIVMTQTPLSLSVTPGQPASISCKSSQSLLHSDGKTYLYWYLQKPGQPPQLLIYEVSNRFSGVPDRFSGSGSGTDFTLKISRVEAEDVG
                         CDR1                              CDR2

VYYCMQGIQLPCSFGQGTKLEIK
      CDR3

U-V$_L$-6 light-chain variable region amino acid sequence (SEQ ID NO:98)
DIVMTQTPLSLSVTPGQPASISCKSSQSLLHSDGKTYLYWYLQKPGQPPQLLIYEVSNRFSGVPDRFSGSGSGTDFTLKISRVEAEDVG
                         CDR1                              CDR2

VYYCMQSIQLPLTFGGGTKVEIK
      CDR3

U-V$_L$-7 light-chain variable region amino acid sequence (SEQ ID NO:98)
DIVMTQTPLSLSVTPGQPASISCKSSQSLLHSDGKTYLYWYLQKPGQPPQLLIYEVSNRFSGVPDRFSGSGSGTDFTLKISRVEAEDVG
                         CDR1                              CDR2

VYYCMQSIQLPLTFGGGTKVEIK
      CDR3

U-V$_L$-8 light-chain variable region amino acid sequence (SEQ ID NO:99)
DIVMTQTPLSLSVTPGQPASISCKSSQSLLHSDGKTYLYWFLQKPGQPPQLLIYEVSNRFSGVPDRFSGSGSGTDFTLKISRVEAEDVG
                         CDR1                              CDR2

VYYCMQSIQLPITFGHGTRLEIK
      CDR3

FIGURE 1B

U-V<sub>L</sub>-9 light-chain variable region amino acid sequence (SEQ ID NO:99)
DIVMTQTPLSLSVTPGQPASISCKSSQSLLHSDGKTYLYWFLQKPGQPPQPLIYEVSNRFSGVPDRFSGSGSGTDFTLKISRVEAEDVG
<u>        CDR1                       </u>                <u>    CDR2   </u>

VYYCMQSIQLPITFGHGTRLEIK
<u>   CDR3   </u>

U-V<sub>L</sub>-11 light-chain variable region amino acid sequence (SEQ ID NO:100)
DIQMTQSPSSLSASVGDRVTITCRASQGIANYLAWYQQKPGKVPKLLIYVASTLQSGVPSRFSGSGSGTDFTLTISSLQPEDVATYYCQ
<u>         CDR1        </u>                  <u>    CDR2   </u>

NYNSAPFTFGPGTKVDIK
<u>  CDR3  </u>

U-V<sub>L</sub>-12 light-chain variable region amino acid sequence (SEQ ID NO:101)
DIQMTQSPSSLSASVGDRVTIICRASQGISNDLAWYQQKPGKVPKLLIYAASTLQSGVPSRFSGSGSGTDFTLTISSLQPEDVATYYCQ
<u>         CDR1        </u>                  <u>    CDR2   </u>

KYNSVPLTFGGGTKVEIK
<u>   CDR3  </u>

U-V<sub>L</sub>-13 light-chain variable region amino acid sequence (SEQ ID NO:102)
NIVMTQTPLSSPVTLGQPASISCRSSQSLVHSDGNTYLSWLQQRPGQPPRLLIYKISNRFSGVPDRFSGSGAGTDFTLKISRVEAEDVG
<u>          CDR1                     </u>                <u>    CDR2   </u>

VYYCMQATQFPHTFGPGTKVDIK
<u>    CDR3   </u>

FIGURE 1C

U-V<sub>L</sub>-14 light-chain variable region amino acid sequence (SEQ ID NO:102)
NIVMTQTPLSSPVTLGQPASISCRSSQSLVHSDGNTYLSWLQQRPGQPPRLLIYKISNRFSGVPDRFSGSGAGTDFTLKISRVEAEDVG
　　　　　　　　　　　　　　　CDR1　　　　　　　　　　　　　　CDR2

VYYCMQATQFPHTFGPGTKVDIK
　　　CDR3

U-V<sub>L</sub>-15 light-chain variable region amino acid sequence (SEQ ID NO:103)
EIVMTQTPLSSPVTLGQPASISCRSSQSLVHSDGNTYLSWLQQRPGQPPRLLIYKISNRFSGVPDRFSGTGAGTDFTLKISRVEAEDVG
　　　　　　　　　　　　　　　CDR1　　　　　　　　　　　　　　CDR2

VYYCMQATQFPHTFGGGTKVEIK
　　　CDR3

U-V<sub>L</sub>-16 light-chain variable region amino acid sequence (SEQ ID NO:104)
EIVLTQSPGTLSLSPGERATLSCRASQTVISSYLAWYQQKPGQAPRLLISGASSRATGIPDRFSGSGSGTDFTLTISRLEPEDFAVYYC
　　　　　　　　　　　　　　　CDR1　　　　　　　　　　　　　　CDR2

QQYGSSPRTFGQGTKVEIK
　　　CDR3

U-V<sub>L</sub>-17 light-chain variable region amino acid sequence (SEQ ID NO:105)
EIVLTQSPGTLSLSPGERATLSCRASQSVSRLAWYQQKPGQAPRLLIYGASRRATGIPDRFSGSGSGTDFTLTISRLEPEDFAVYYCQQ
　　　　　　　　　　　　　　　CDR1　　　　　　　　　　　　　　CDR2

YGSSPRSFGQGTKLEIK
　　　CDR3

FIGURE 1D

U-V<sub>L</sub>-18 light-chain variable region amino acid sequence (SEQ ID NO:106)
DIQMTQSPSSLSASVGDRVTITC<u>RASQGIRNDLG</u>WYQQKPGKAPKRLIY<u>AASSLQS</u>GVPSRFSGSGSGTEFTLTISSLQPEDFATYYC<u>L</u>
                      CDR1                                  CDR2

<u>QHNSYPPT</u>FGQGTKVEIK
  CDR3

U-V<sub>L</sub>-19 light-chain variable region amino acid sequence (SEQ ID NO:107)
DIVMTQSPDSLAVSLGERATINCK<u>SSQSVLYSSNNKNYLVW</u>YQQKPGQPPKLFIY<u>WASTRES</u>GVPDRFTGSGSGTDFTLTISSLQAEDV
                          CDR1                                  CDR2

AVYYC<u>QQYYSFPWT</u>FGQGTKVEIK
     CDR3

U-V<sub>L</sub>-20 light-chain variable region amino acid sequence (SEQ ID NO:107)
DIVMTQSPDSLAVSLGERATINCK<u>SSQSVLYSSNNKNYLVW</u>YQQKPGQPPKLFIY<u>WASTRES</u>GVPDRFTGSGSGTDFTLTISSLQAEDV
                          CDR1                                  CDR2

AVYYC<u>QQYYSFPWT</u>FGQGTKVEIK
     CDR3

U-V<sub>L</sub>-21 light-chain variable region amino acid sequence (SEQ ID NO:108)
DIVMTQSPDSLAVSLGERATINCK<u>SSQSVLYSSNNKNYLAW</u>YQQKPGQPPKLLIY<u>WASTRES</u>GVPDRFSGSGSGTDFTLTISSLQAEDV
                          CDR1                                  CDR2

AVYYC<u>QQYYSTTWT</u>FGQGTKVEIK
     CDR3

FIGURE 1E

U-V$_L$-22 light-chain variable region amino acid sequence (SEQ ID NO:109)
DIVMTQSPDSLAVSLGERATINCKSSQNVLYSSNNKNYLAWYQQKPGQPPKLLIYWASTRESGVPDRFSGSGSGTDFTLTISSLQAEDV
                       CDR1                                                   CDR2

AVYFCQQYYGTPRTFGQGTKVEIK
     CDR3

U-V$_L$-23 light-chain variable region amino acid sequence (SEQ ID NO:110)
DIVMTQSPDSLAVSLGERATINCKSSQNVLYSSNNKNYLAWYQQKPGQPPKLLIYWASTRESGVPDRFSGSGSGTDFTLTISSLQAEDV
                       CDR1                                                   CDR2

AVYFCQQYYGTPRTFGQGTKVEIK
     CDR3

U-V$_L$-24 light-chain variable region amino acid sequence (SEQ ID NO:111)
DIVMTQSPDSLTVSLGERATINCKSSQSVLYSSNNKNYLAWYQQKPGQPPKLLIYWASTRESGVPDRFGGSGSGTDFTLTISSLQAEDV
                       CDR1                                                   CDR2

AVYYCQQYSISRTFGQGTKVEIK
     CDR3

U-V$_L$-25 light-chain variable region amino acid sequence (SEQ ID NO:111)
DIVMTQSPDSLTVSLGERATINCKSSQSVLYSSNNKNYLAWYQQKPGQPPKLLIYWASTRESGVPDRFGGSGSGTDFTLTISSLQAEDV
                       CDR1                                                   CDR2

AVYYCQQYSISRTFGQGTKVEIK
     CDR3

FIGURE 1F

U-V$_L$-26 light-chain variable region amino acid sequence (SEQ ID NO:112)
DIVMTQSPDSLAVSLGERATINCKSSQSVLYNSNNKNYLAWYQQKPGQPPKLLLIYWASTRESGVPDRFSGSGSGTDFTLTISSLQADDV
　　　　　　　　　　　　　　　CDR1　　　　　　　　　　　　　　　　CDR2

AVYYCQQYYSTTWTFGPGTKVEIK
　　　CDR3

U-V$_L$-27 light-chain variable region amino acid sequence (SEQ ID NO:113)
DIVMTQSPDSLAVSLGERATINCKSSQSVLYNSNNKNYLAWYQQKPGQPPKLLLIYWASTRESGVPDRFSGSGSGTDFTLTISSLQADDV
　　　　　　　　　　　　　　　CDR1　　　　　　　　　　　　　　　　CDR2

AVYYCQQYYSTTWTFGPGTKVEIK
　　　CDR3

U-V$_L$-28 light-chain variable region amino acid sequence (SEQ ID NO:114)
DIVMTQSPDSLAVSLGERATINCKSSQSVLYSSNNKNYLAWYQQKPGQPPKVLIYWASTRKSGVPDRFSGSGSGTDFTLTISGLQAEDV
　　　　　　　　　　　　　　　CDR1　　　　　　　　　　　　　　　CDR2

ALYYCQQYYSTMFSFGQGTKLEIK
　　　CDR3

U-V$_L$-29 light-chain variable region amino acid sequence (SEQ ID NO:114)
DIVMTQSPDSLAVSLGERATINCKSSQSVLYSSNNKNYLAWYQQKPGQPPKVLIYWASTRKSGVPDRFSGSGSGTDFTLTISGLQAEDV
　　　　　　　　　　　　　　　CDR1　　　　　　　　　　　　　　　CDR2

ALYYCQQYYSTMFSFGQGTKLEIK
　　　CDR3

FIGURE 1G

U-V_L-30 light-chain variable region amino acid sequence (SEQ ID NO:115)
DIVMTQSPDSLAVSLGERATINCKSSQSVLDSSNNKNYLAWYQQKPGQPPKLLIYWASTRESGVPDRFSGSGSGTDFTLTISSLQAEDV
　　　　　　　　　　　　　　　　　　CDR1　　　　　　　　　　　　　　　　　　　CDR2
AVFYCHQYYSTPLTFGGGTKVAIK
　　　CDR3

U-V_L-31 light-chain variable region amino acid sequence (SEQ ID NO:115)
DIVMTQSPDSLAVSLGERATINCKSSQSVLDSSNNKNYLAWYQQKPGQPPKLLIYWASTRESGVPDRFSGSGSGTDFTLTISSLQAEDV
　　　　　　　　　　　　　　　　　　CDR1　　　　　　　　　　　　　　　　　　　CDR2
AVFYCHQYYSTPLTFGGGTKVAIK
　　　CDR3

U-V_L-32 light-chain variable region amino acid sequence (SEQ ID NO:116)
DIVMTQSPDSLAVSLGERATINCKSSQSILYRSNNKNYLAWYQQKPGQPPKLLIYWASARESGVPDRFSGSGSGTDFTLTISSLQAEDV
　　　　　　　　　　　　　　　　　　CDR1　　　　　　　　　　　　　　　　　　　CDR2
AVYFCQQYFITPLTFGGGTKVEIK
　　　CDR3

U-V_L-33 light-chain variable region amino acid sequence (SEQ ID NO:116)
DIVMTQSPDSLAVSLGERATINCKSSQSILYRSNNKNYLAWYQQKPGQPPKLLIYWASARESGVPDRFSGSGSGTDFTLTISSLQAEDV
　　　　　　　　　　　　　　　　　　CDR1　　　　　　　　　　　　　　　　　　　CDR2
AVYFCQQYFITPLTFGGGTKVEIK
　　　CDR3

FIGURE 1H

U-V<sub>L</sub>-34 light-chain variable region amino acid sequence (SEQ ID NO:117)
DIQMTQSPSSLSASVGDRVTITCRASQDISHYLAWFQQKPGKAPKSLIYAASSLQSGVPSKFSGSGSGTDFTLTISSLQPEDFATYYCQ
              CDR1                                CDR2

QYNNYPFTFGPGTKVDIK
CDR3

U-V<sub>L</sub>-35 light-chain variable region amino acid sequence (SEQ ID NO:118)
DIQMTQSPSSLSASVGDRVAITCRASQDISNYLAWLQQKPGKAPKSLIYAASSLQSGVPSRFSGSGSGTDFTLTISSLQPEDFATYYCQ
              CDR1                                CDR2

QYNTYPFTFGPGTKMDIK
CDR3

U-V<sub>L</sub>-36 light-chain variable region amino acid sequence (SEQ ID NO:119)
EIVMTQSPATLSVSPGERATLSCRASQSVSSNLAWYQQDPGQAPRLLIYGASRRATGIPARFSGSGSGTEFTLTISSLQSEDFAVYYCQ
              CDR1                                CDR2

QHNNWPPWTFGQGTKVEIK
CDR3

U-V<sub>L</sub>-37 light-chain variable region amino acid sequence (SEQ ID NO:119)
EIVMTQSPATLSVSPGERATLSCRASQSVSSNLAWYQQDPGQAPRLLIYGASRRATGIPARFSGSGSGTEFTLTISSLQSEDFAVYYCQ
              CDR1                                CDR2

QHNNWPPWTFGQGTKVEIK
CDR3

FIGURE 1I

U-V_L-38 light-chain variable region amino acid sequence (SEQ ID NO:120)
DIQMTQSPSSVSASVGDRVTITCRASQDISRWLAWYQQKPGKAPKLLIYAASSLQSGVPSRFSGSGSGTDFTLTISSLQPEDFATYYCQ
                      CDR1                          CDR2

QANSFPPTFGQGTKVEFK
CDR3

U-V_L-39 light-chain variable region amino acid sequence (SEQ ID NO:121)
DIQMTQSPSSLSASVGDRVTITCRASQSISTYLNWYQQKPGKAPKFLIYAASSLQSGVPSRFSGSGSGTDFTLTISSLQPEDFAAYYCQ
                      CDR1                          CDR2

QSHSAPFTFGPGTKVDIK
CDR3

U-V_L-40 light-chain variable region amino acid sequence (SEQ ID NO:122)
DIQMTQSPSSLSASLGDRVTITCRASQTISIYLNWYQQKPGKAPKLLIYAASSLQSGVPSRFSGSGSGTDFTLTISSLQPEDFATYYCQ
                      CDR1                          CDR2

QSYSTLTFGGGTKVEIK
CDR3

U-V_L-41 light-chain variable region amino acid sequence (SEQ ID NO:123)
DIQMTQSPSSLSASVGDRVTITCRASQSIRSYLNWYQQRPGNAPKLLIYAASSLQSGVPSRVSGSGSGTDFTLTIRSLQPEDFATYYCQ
                      CDR1                          CDR2

QSYSIPLTFGGGTKVEIK
CDR3

FIGURE 1J

U-V<sub>L</sub>-42 light-chain variable region amino acid sequence (SEQ ID NO:124)
DIQMTQSPSSRSASVGDRVTITCRASQTISRYLNWYQQKPGKAPKLLIYAASTLQSGVPSRFSGSGSGTDFTLTLSSLQPEDFATYYCQ
                      CDR1                       CDR2

QIYSTSITFGQGTRLEIK
CDR3

U-V<sub>L</sub>-43 light-chain variable region amino acid sequence (SEQ ID NO:125)
DIQMTQSPSSLSASVGDRVTITCRASQRISSYLNWYQQKPGKAPKVLIYAESSLQSGVPSRFSGSGSGTDFTLTISSLQPEDFATYYCQ
                        CDR1                       CDR2

QSYITPITFGQGTRLEII
CDR3

U-V<sub>L</sub>-44 light-chain variable region amino acid sequence (SEQ ID NO:126)
DIQMTQSPSSLSASVGDRVTITCRASQSISRYLNWYQQKPGKAPKLLIYTASSLQSGVPSRFSGSGSGTDFTLTISSLQPENFATYYCQ
                        CDR1                       CDR2

QSYFTPITFGQGTRLEIK
CDR3

U-V<sub>L</sub>-45 light-chain variable region amino acid sequence (SEQ ID NO:127)
DIQMTQSPSSLSASVGDRVTITCRASQSISSYLNWYQQKPGKAPKLLIYTASSLQSGVPSRFSGSGSGTDFTLTFSSLQPEDFATYYCQ
                        CDR1                       CDR2

QSYFSPITFGQGTRLEIK
CDR3

FIGURE 1K

U-V<sub>L</sub>-46 light-chain variable region amino acid sequence (SEQ ID NO:128)
DIQMTQSPSSLSASVGDRVTITCRASQSISSYLNWYQQKPGKAPKLLIYTASSLQSGVPSRFSGSGSGTDFTLTLSSLQPEDFASYYCQ
                            CDR1                                       CDR2

QSFYTPITFGQGTRLEIK
  CDR3

U-V<sub>L</sub>-47 light-chain variable region amino acid sequence (SEQ ID NO:128)
DIQMTQSPSSLSASVGDRVTITCRASQSISSYLNWYQQKPGKAPKLLIYTASSLQSGVPSRFSGSGSGTDFTLTLSSLQPEDFASYYCQ
                            CDR1                                       CDR2

QSYFTPITFGQGTRLEIK
  CDR3

U-V<sub>L</sub>-48 light-chain variable region amino acid sequence (SEQ ID NO:129)
DIQMTQSPSSLSASVGDRVTITCRASQSISSYLNWYQQKPGKAPKLLIYTVSSLQSGVPSRFSGSGSGTDFTLTISSLQPEDFATYYCQ
                            CDR1                                       CDR2

QSYFTPITFGQGTRLEIK
  CDR3

U-V<sub>L</sub>-49 light-chain variable region amino acid sequence (SEQ ID NO:129)
DIQMTQSPSSLSASVGDRVTITCRASQSISSYLNWYQQKPGKAPKLLIYTVSSLQSGVPSRFSGSGSGTDFTLTISSLQPEDFATYYCQ
                            CDR1                                       CDR2

QSYFTPITFGQGTRLEIK
  CDR3

FIGURE 1L

U-V<sub>L</sub>-50 light-chain variable region amino acid sequence (SEQ ID NO:129)
DIQMTQSPSSLSASVGDRVTITCRASQSISSYLNWYQQKPGKAPKLLIYTVSSLQSGVPSRFSGSGSGTDFTLTISSLQPEDFATYYCQ
　　　　　　　　　　　　　　　　　CDR1　　　　　　　　　　　　　CDR2

QSYFTPITFGQGTRLEIK
CDR3

U-V<sub>L</sub>-51 light-chain variable region amino acid sequence (SEQ ID NO:130)
DIQMTQSPSSLSASVGDRVTITCRASQSISSYLNWYQQKPGKAPKLLIYTASSLQSGVPSRFSGSGSGTDFTLTISSLQPEDFASYYCQ
　　　　　　　　　　　　　　　　　CDR1　　　　　　　　　　　　　CDR2

QSFYAPITFGQGTRLEIK
CDR3

U-V<sub>L</sub>-52 light-chain variable region amino acid sequence (SEQ ID NO:130)
DIQMTQSPSSLSASVGDRVTITCRASQSISSYLNWYQQKPGKAPKLLIYTASSLQSGVPSRFSGSGSGTDFTLTISSLQPEDFASYYCQ
　　　　　　　　　　　　　　　　　CDR1　　　　　　　　　　　　　CDR2

QSFYAPITFGQGTRLEIK
CDR3

U-V<sub>L</sub>-53 light-chain variable region amino acid sequence (SEQ ID NO:131)
DIQMTQSPSSLSASVGDRVTITCRASQSISSYLNWYQQKPGKAPKLLIYTASSLQSGVPSRFSGSGSGTDFTLTISSLQPEDFATYYCQ
　　　　　　　　　　　　　　　　　CDR1　　　　　　　　　　　　　CDR2

QSYFTPITFGQGTRLEIK
CDR3

FIGURE 1M

U-V_L-54 light-chain variable region amino acid sequence (SEQ ID NO:132)
DIQMTQSPSSLSASVGDRVTITC<u>QASQDISNYLN</u>WYQQKPGKAPKLLIY<u>DASNLET</u>GVPSRFSGSGSGTDFTFTISSLQPEDIATYYC<u>Q</u>
           CDR1         CDR2

<u>QYDYLPFT</u>FGPGTKVDIK
CDR3

U-V_L-55 light-chain variable region amino acid sequence (SEQ ID NO:132)
DIQMTQSPSSLSASVGDRVTITC<u>QASQDISNYLN</u>WYQQKPGKAPKLLIY<u>DASNLET</u>GVPSRFSGSGSGTDFTFTISSLQPEDIATYYC<u>Q</u>
           CDR1         CDR2

<u>QYDYLPFT</u>FGPGTKVDIK
CDR3

U-V_L-56 light-chain variable region amino acid sequence (SEQ ID NO:133)
DIQMTQSPSSLSASVGDRVTITC<u>QASQDISNSLNW</u>YQQKPGKAPELLIY<u>DASNLET</u>GVPSRFSGSGSGTDFTFTISSLQPEDIATYYC<u>Q</u>
           CDR1         CDR2

<u>QCDDLPLT</u>FGGGTKVEIK
CDR3

U-V_L-57 light-chain variable region amino acid sequence (SEQ ID NO:134)
DIQMTQSPSSLSASVGDRVTITC<u>QASQDISDYLN</u>WYQQKPGKAPKLLIY<u>DASNLET</u>GVPSRFSGSGSGTDFTFTISSLQPEDIATYYC<u>Q</u>
           CDR1         CDR2

<u>HYDNLPLT</u>FGGGTKVEIK
CDR3

FIGURE 1N

U-V_L-58 light-chain variable region amino acid sequence (SEQ ID NO:135)
DIQMTQSPSSLSASVGDRVAITCQASQDISNYLNWYQQKPGKAPKLLIYDASNLETGVPSRFSGSGSGTDFTFTISSLQPEDIATYYCQ
                                          CDR1                               CDR2

QYDNLPLTFGGGTKVEIK
CDR3

U-V_L-59 light-chain variable region amino acid sequence (SEQ ID NO:135)
DIQMTQSPSSLSASVGDRVAITCQASQDISNYLNWYQQKPGKAPKLLIYDASNLETGVPSRFSGSGSGTDFTFTISSLQPEDIATYYCQ
                                          CDR1                               CDR2

QYDNLPLTFGGGTKVEIK
CDR3

U-V_L-60 light-chain variable region amino acid sequence (SEQ ID NO:136)
DIQMTQSPSSLSASVGDRVTITCQASQDISNSLNWYQQKPGKAPKLLIYDASILETGVPSRFSGSGSETDFTFTISSLQPEDIATYYCQ
                                          CDR1                               CDR2

QCDILPLSFGGGTKVEIK
CDR3

U-V_L-61 light-chain variable region amino acid sequence (SEQ ID NO:137)
DIQMTQSPSSLSASVGDRVTITCQASQDISNSLNWYQQKPGKAPKLLIYDASNLETGVPSRFSGSGSGTDFTFTISSLQPEDIATYYCQ
                                          CDR1                               CDR2

QYDNLPLAFGGGTKVEIR
CDR3

FIGURE 10

U-V<sub>L</sub>-62 light-chain variable region amino acid sequence (SEQ ID NO:138)
DIQMTQSPSSLSASVGDGVTITCQ<u>ASQDITNYLN</u>WYQQKPGKAPKLLIY<u>DASNLET</u>GVPSRFSGSGSGTDFTFTISSLQPEDIATYYCQ
                    CDR1                            CDR2

<u>QYDSLPIT</u>FGQGTRLEIK
CDR3

U-V<sub>L</sub>-63 light-chain variable region amino acid sequence (SEQ ID NO:139)
DIQMTQSPSSLSASVGDRVTITCQ<u>ASQDISNYLN</u>WYQQKLGKAPKLLIH<u>DASNLET</u>GVPSRFSGSGSGTDFTFTISSLQPEDIATYYCQ
                    CDR1                            CDR2

<u>QYDNLPIT</u>FGQGTRLEIK
CDR3

U-V<sub>L</sub>-64 light-chain variable region amino acid sequence (SEQ ID NO:140)
DIQMTQSPSPSSLSASVGDRVTITCQ<u>ASQDISDYLN</u>WYQQKPGKAPKLLIY<u>DASNLET</u>GVPSRFSGSGSGTDFTFTISSLQPEDIATYYCQ
                    CDR1                            CDR2

<u>HYDNLPIT</u>FGQGTRLEIK
CDR3

U-V<sub>L</sub>-65 light-chain variable region amino acid sequence (SEQ ID NO:141)
DIQMTQSPSSLSASVGDRVTITCQ<u>ASQDISNSLN</u>WYQQKPGKAPKLLIY<u>DASNLET</u>GVPSRFSGSGSGTDFTFTISSLQPEDIATYYCQ
                    CDR1                            CDR2

<u>HYDNLPIT</u>FGQGTRLEIK
CDR3

FIGURE 1P

U-V_H-1 heavy chain variable region amino acid sequence (SEQ ID NO:142)
QVQLVQSGAEVKKPGASVKVSCKASGYTFTSYGISWVRQAPGQGLEWMGWISASNGNTNYAQKLQDRVTMTDTSTSTAYMELRSLRSD
　　　　　　　　　　　　　　　CDR1　　　　　　　　　　　　CDR2

DTAVYYCAREDNWNYGFFDYWGQGTLVTVSS
　　　　　CDR3

U-V_H-2 heavy chain variable region amino acid sequence (SEQ ID NO:142)
QVQLVQSGAEVKKPGASVKVSCKASGYTFTSYGISWVRQAPGQGLEWMGWISASNGNTNYAQKLQDRVTMTDTSTSTAYMELRSLRSD
　　　　　　　　　　　　　　　CDR1　　　　　　　　　　　　CDR2

DTAVYYCAREDNWNYGFFDYWGQGTLVTVSS
　　　　　CDR3

U-V_H-3 heavy chain variable region amino acid sequence (SEQ ID NO:143)
QVHLVQSGAEVKKPGASVKVSCKVSGYTFTGHYMHWVRQAPGQGLEWMGWINPNSGGTNCAQKFQGRVTMTRDTSISTAYMELSRLRSD
　　　　　　　　　　　　　　　CDR1　　　　　　　　　　　　CDR2

DTAVYYCARSIAVALDYWGQGTLVTVSS
　　　　　CDR3

U-V_H-4 heavy chain variable region amino acid sequence (SEQ ID NO:144)
QVQLVQSGAEVKKPGASVKVSCKASGYTFTGYYMHWVRQAPGQGLEWMGWINPNSGGTNHTQKFQGRVTMTRDTSISTAYMELSRLRSD
　　　　　　　　　　　　　　　CDR1　　　　　　　　　　　　CDR2

DTAVYYCARSIAVALDYWGQGTLVTVSS
　　　　　CDR3

FIGURE 2A

U-V<sub>H</sub>-5 heavy chain variable region amino acid sequence (SEQ ID NO:145)
QVQLVQSGAEVRKPGASVKVSCKVSGYTLTELSMHWVRQAPGKGLEWMGSFDPEDGETIYAQKFQGRVTMLEDTSTDTAYMELSSLRSE
                                  CDR1                                        CDR2

DTAVYYCATEGDGGYYYYGMDVWGQGTTVTVSS
        CDR3

U-V<sub>H</sub>-6 heavy chain variable region amino acid sequence (SEQ ID NO:145)
QVQLVQSGAEVRKPGASVKVSCKVSGYTLTELSMHWVRQAPGKGLEWMGSFDPEDGETIYAQKFQGRVTMLEDTSTDTAYMELSSLRSE
                                  CDR1                                        CDR2

DTAVYYCATEGDGGYYYYGMDVWGQGTTVTVSS
        CDR3

U-V<sub>H</sub>-7 heavy chain variable region amino acid sequence (SEQ ID NO:146)
QVTLKESGPVLVKPTETLTLTCTVSGFSLSNARMGVSWIRQPPGKALEWLAHIFSNDEKSYSTSLKSRLTISKDTSKSQVVLTMTNMDP
                                  CDR1                                        CDR2

VDTATYYCARMYSSGWYGVFDYWGQGTLVTVSS
        CDR3

U-V<sub>H</sub>-8 heavy chain variable region amino acid sequence (SEQ ID NO:147)
QVTLKESGPVLVKPTETLTLTCTVSGFSLSNARMGVSWIRQPPGKALEWLVLIFSNDEKSYSTSLKSRLTISKDTSKSQVVLTMTNMDP
                                  CDR1                                        CDR2

VDTATYYCARVYSSGWSFYGMDVWGQGTTVTVSS
        CDR3

FIGURE 2B

U-V$_H$-9 heavy chain variable region amino acid sequence (SEQ ID NO:148)
QITLKESGPTLVKPTQTLTLTCTFSGFSLSTGGVGVGWIRQPPGKALEWLALIYWNDDKRYSPSLKSRLTITKDTSKNQVVLTMTNMDP
<u>CDR1</u>                                      <u>CDR2</u>
VDTATYYCAHRRELPFDYWGQGTLVTVSS
        <u>CDR3</u>

U-V$_H$-10 heavy chain variable region amino acid sequence (SEQ ID NO:149)
QITLKESGPTLVKPTQTLTLTCTFSGFSLSTGGVGVGWIRQPPGKALEWLALIYWNDDKRYSPSLKSRLTITKDTSKTQVVLTVTDMDP
<u>CDR1</u>                                      <u>CDR2</u>
VDTATYYCAHRNWTPFDYWGQGTLVTVSS
        <u>CDR3</u>

U-V$_H$-11 heavy chain variable region amino acid sequence (SEQ ID NO:150)
QITLKESGPTLVKPTQTLTLTCTFSGFSLNTGGVGVGWIRQPPGKALEWLALIYWNDDKRYSPSLKSRLTITKDTSKNQVVLTMTNMDP
<u>CDR1</u>                                      <u>CDR2</u>
VDTATYYCAHRLELPFDYWGQGTLVTVSS
        <u>CDR3</u>

U-V$_H$-12 heavy chain variable region amino acid sequence (SEQ ID NO:151)
QITLKESGPTLVKPTQTLTLTCTFSGFSLSTGGVGVGWIRQPPGKALEWLALIYWNDDKRYSPSLKSRLTITKDTSKNQVVLTMTNLDP
<u>CDR1</u>                                      <u>CDR2</u>
VDTATYYCAHRREVPFDYWGQGTLVTVSS
        <u>CDR3</u>

FIGURE 2C

U-V$_H$-13 heavy chain variable region amino acid sequence (SEQ ID NO:152)
QITLKESGPTLVKPTQTLTLTCTFSGFSLSTGGVGVGWIRQPPGKALEWLA<u>LIYWNVEKRY</u>SPSLRSRLTITKATSKNQVVLTMTNMDP
                              <u>CDR1</u>                                                          <u>CDR2</u>

VDTATYYC<u>AHRHTNPFEY</u>WGQGTLVTVSS
          <u>CDR3</u>

U-V$_H$-14 heavy chain variable region amino acid sequence (SEQ ID NO:153)
QITLKESGPTLVKPTQTLTLTCTFSGFSLSTGGVGVGWIRQPPGKALEWLA<u>LIYWNDDKRY</u>SPSLKSRLTITKDTSKNQVVLTMTNMDP
                              <u>CDR1</u>                                                          <u>CDR2</u>

VDTATYYC<u>AHRGELPFDY</u>WGQGTLVTVSS
          <u>CDR3</u>

U-V$_H$-15 heavy chain variable region amino acid sequence (SEQ ID NO:153)
QITLKESGPTLVKPTQTLTLTCTFSGFSLSTGGVGVGWIRQPPGKALEWLA<u>LIYWNDDKRY</u>SPSLKSRLTITKDTSKNQVVLTMTNMDP
                              <u>CDR1</u>                                                          <u>CDR2</u>

VDTATYYC<u>AHRGELPFDY</u>WGQGTLVTVSS
          <u>CDR3</u>

U-V$_H$-16 heavy chain variable region amino acid sequence (SEQ ID NO:154)
EVQLVESGGGLVKPGGSLRLSCAASGFPFSRY<u>SMN</u>WVRQAPGKGLEWVS<u>AISSSSSYIYYADS</u>VKGRFTISRDNAKNSLYLQMNSLRAE
                                <u>CDR1</u>                                     <u>CDR2</u>

DTAVYYC<u>ARDRVGATPDAFDI</u>WGQGTMVTVSS
        <u>CDR3</u>

FIGURE 2D

U-V$_H$-17 heavy chain variable region amino acid sequence (SEQ ID NO:155)
EVQLLESGGGLVQPGGSLRLSCAASGFTFSSYA<u>MNWVRQAPGKGLEWVSAISGSGGSTYYADSVKG</u>RFTISRDNSKNTLYLQMNSLRAE
　　　　　　　　　　　　　　　　　　　CDR1　　　　　　　　　　　　　　　　CDR2

DTAVYYCAKE<u>GIAVAGTAEYYYYYAMDV</u>WGQGTTVTVSS
　　　　　　　　　CDR3

U-V$_H$-18 heavy chain variable region amino acid sequence (SEQ ID NO:156)
EVQLLESGGGLVQPGGSLRLSCAASGFTFSSYA<u>MSWVRQAPGKGLEWVSAISGSGGSTYYADSVKG</u>RFTISRDNSKNTLYLQMNSLRAE
　　　　　　　　　　　　　　　　　　　CDR1　　　　　　　　　　　　　　　　CDR2

DTAVYYCAKE<u>GIAARDSYYYYAMDV</u>WGQGTTVTVSS
　　　　　　　CDR3

U-V$_H$-19 heavy chain variable region amino acid sequence (SEQ ID NO:157)
EVQLLESGGGLVQPGGSLRLSCTASGFTFSSYA<u>MSWVRQAPGKGLEWVSAISGSGGSTYYADSVKG</u>RFTISRDNSKNTLYLQMNSLRAE
　　　　　　　　　　　　　　　　　　　CDR1　　　　　　　　　　　　　　　　CDR2

DTAEYYCAKE<u>GIAGRDSYYYYGMDV</u>WGQGTTVTVSS
　　　　　　　CDR3

U-V$_H$-20 heavy chain variable region amino acid sequence (SEQ ID NO:157)
EVQLLESGGGLVQPGGSLRLSCTASGFTFSSYA<u>MSWVRQAPGKGLEWVSAISGSGGSTYYADSVKG</u>RFTISRDNSKNTLYLQMNSLRAE
　　　　　　　　　　　　　　　　　　　CDR1　　　　　　　　　　　　　　　　CDR2

DTAEYYCAKE<u>GIAGRDSYYYYGMDV</u>WGQGTTVTVSS
　　　　　　　CDR3

FIGURE 2E

U-V<sub>H</sub>-21 heavy chain variable region amino acid sequence (SEQ ID NO:158)
QVQLVESGGGVVQPGRSLRLSCAASGFTFSSYGMHWVRQAPGKGLEWVAFISDDGSTKYYADSVKGRFTISRDNSMNTLYLQMNSLRAE
                                  CDR1                                         CDR2

DTAVYYCARSYDSSGYYYGFDYWGQGTLVTVSS
       CDR3

U-V<sub>H</sub>-22 heavy chain variable region amino acid sequence (SEQ ID NO:158)
QVQLVESGGGVVQPGRSLRLSCAASGFTFSSYGMHWVRQAPGKGLEWVAFISDDGSTKYYADSVKGRFTISRDNSMNTLYLQMNSLRAE
                                  CDR1                                         CDR2

DTAVYYCARSYYDSSGYYYGFDYWGQGTLVTVSS
       CDR3

U-V<sub>H</sub>-23 heavy chain variable region amino acid sequence (SEQ ID NO:159)
QVQLVESGGGVVQPGRSLRLSCAASGFTFSSYGMHWVRQAPGKGLEWVAVIWYDGSNKYYADSVKGRFTISRDNSKNTLYLQMNSLRAE
                                  CDR1                                         CDR2

DTAVYYCARNVIDYWGQGTLVTVSS
       CDR3

U-V<sub>H</sub>-24 heavy chain variable region amino acid sequence (SEQ ID NO:160)
QVQLVESGGGVVQPGRSLRLSCAASGFTFSSYDMHWVRQAPGKGLEWVAVIWYDGSIKYYADSVKGRFTISRDNSKNTLYLQMNSLRAE
                                  CDR1                                         CDR2

DTAVYYCARGGATGAEYFQHWGQGTLVTVSS
       CDR3

FIGURE 2F

U-V$_H$-25 heavy chain variable region amino acid sequence (SEQ ID NO:160)
QVQLVESGGGVVQPGRSLRLSCAASGFTFSSYDMHWVRQAPGKGLEWVAVIWYDGSIKYYADSVKGRFTISRDNSKNTLYLQMNSLRAE
                                                CDR1                                  CDR2

DTAVYYCARGGATGAEYFQHWGQGTLVTVSS
        CDR3

U-V$_H$-26 heavy chain variable region amino acid sequence (SEQ ID NO:161)
QVQLVESGGGVVQPGRSLRLSCAASGFTFSSYGMHWVRQAPGKGLEWVAVIWYDGSNKYYADSVKGRFTISRDNSKNTLYLQMNSLRAE
                                                CDR1                                  CDR2

DTAVYYCVLLMFGETFDYWGQGSLVTVSP
        CDR3

U-V$_H$-27 heavy chain variable region amino acid sequence (SEQ ID NO:162)
QVQLVESGGGVVQPGRSLRLSCAASGFTFSSYGMHWVRQAPGKGLEWVAVIWSDGSNKYYADSVKGRFTISRDNSKNTLYLQMNSLRAE
                                                CDR1                                  CDR2

DTAVYYCARNLPFDYWGQGTLVTVSS
        CDR3

U-V$_H$-28 heavy chain variable region amino acid sequence (SEQ ID NO:163)
QVQLVESGGGVVQPGRSLRLSCAASGFTFSSYGMHWVRQAPGKGLEWVAVIWDDGSNQYYTDSVKGRFTVSRDNSKNTLFLQMNSLRAE
                                                CDR1                                  CDR2

DTAVYYCARSHYGGDYDYYGMDVWGQGTTVTVSS
        CDR3

FIGURE 2G

U-V$_H$-29 heavy chain variable region amino acid sequence (SEQ ID NO:164)
QVQLVESGGGVVQPGRSLRLSCAASGFTFSSYGMHWVRQAPGKGLEWVAVIWYDGSNKRYVDSVKGRFTISRDNSKNTLYLQMNSLRAE
                                       CDR1                                             CDR2

DTAVYYCARDGWQQQAPFDYWGQGTLVTVSS
          CDR3

U-V$_H$-30 heavy chain variable region amino acid sequence (SEQ ID NO:165)
QVQLVESGGGVVQPGRSLRLSCAASGFTFRSHGMHWVRQAPGKGLEWVAVIWYDGSNKNYADSVRGRFTISRDNSKNTLDLQMNSLRAE
                                       CDR1                                             CDR2

DTAVYYCARWGISAPFDCWGQGTLVTVSS
          CDR3

U-V$_H$-31 heavy chain variable region amino acid sequence (SEQ ID NO:166)
EVQLVESGGGLVQPGGSLRLSCAASGFTFSAYSMNWVRQAPGKGLEWVSYISSSGRTIYYADSVKGRFTISRDNAKNSLFLQMNSLRDE
                                       CDR1                                           CDR2

DTAVYYCALWAPFDYWGQGTLVTVSS
          CDR3

U-V$_H$-32 heavy chain variable region amino acid sequence (SEQ ID NO:167)
EVQLVESGGGLVQPGGSLRLSCAASGFTFSSYSMNWVRQAPGKGLEWVSHISSSSRTIYYADSVKGRFTISRDNAKNSVYLQMNSLRDE
                                       CDR1                                           CDR2

DTAVYYCARDGYNWNGGGNYYGMDVWGQGTTVTVSS
         CDR3

FIGURE 2H

U-V<sub>H</sub>-33 heavy chain variable region amino acid sequence (SEQ ID NO:168)
EVQLVESGGGLVQPGGSLRLSCAASGFTFSSYSMNWVRQAPGKGLEWVSHISRSSRTIYYADSVKGRFTISRDNAKNSLYLQMNSLRDE
                                  CDR1                                            CDR2

DTAVYYCARDGYNWNNGGYYYGMDVWGQGTTVTVSS
            CDR3

U-V<sub>H</sub>-34 heavy chain variable region amino acid sequence (SEQ ID NO:168)
EVQLVESGGGLVQPGGSLRLSCAASGFTFSSYSMNWVRQAPGKGLEWVSHISRSSRTIYYADSVKGRFTISRDNAKNSLYLQMNSLRDE
                                  CDR1                                            CDR2

DTAVYYCARDGYNWNNGGYYYGMDVWGQGTTVTVSS
            CDR3

U-V<sub>H</sub>-35 heavy chain variable region amino acid sequence (SEQ ID NO:169)
QVQLQESGPGLVKPSQTLSLTCTVSGGSVSSGGYYWSWIRQHPGKGLEWIGYIHSGSTYYNPSLKSRVTISVDTSKNQFSLNLSSVTA
                                 CDR1                                       CDR2

ADTAVYYCARGPYYGMDVWGQGTTVTVSS
       CDR3

U-V<sub>H</sub>-36 heavy chain variable region amino acid sequence (SEQ ID NO:170)
QVQLQESGPGLVKPSQTLSLTCTVSGGSISRGGYYWSWIRQHPGKGLEWIGYIHSGSTYYNPSLKSRVNMSVDTSKNQFSLKLSSVTA
                                 CDR1                                       CDR2

ADTAVYYCARALRGIVLMVYVLGALDIWGQGTKVTVSS
             CDR3

FIGURE 2I

U-V_H-37 heavy chain variable region amino acid sequence (SEQ ID NO:170)
QVQLQESGPGLVKPSQTLSLTCTVSGGSISRGGYYWSWIRQHPGKGLEWIGYIYHSGSTYYNPSLKSRVNMSVDTSKNQFSLKLSSVTA
                   CDR1                              CDR2
ADTAVYYCARALRGIVLMVYVLGALDIWGQGTKVTVSS
            CDR3

U-V_H-38 heavy chain variable region amino acid sequence (SEQ ID NO:171)
QVQLQESGPGLVKPSQTLSLTCTVSGGSISSGGYYWSWIRQHPGKGLEWIGYIYYSGSTYYNPSLKSRVTISVDTSKNQFSLKLSSVTA
                   CDR1                              CDR2
ADTAVYYCARDETVVRGLIRYCYGMDVWGQGTTVTVSS
            CDR3

U-V_H-39 heavy chain variable region amino acid sequence (SEQ ID NO:172)
QVQLQESGPGLVKPSQTLSLNCTVSGGSISSGGYYWSWIRQHPGKGLEWIGYIHYSGSTYYNPSLKSRITISADTSKNQFSLKLNSVTA
                   CDR1                              CDR2
ADTAVYYCARDRGGGDYGRMDVWGQGTTVTVSS
            CDR3

U-V_H-40 heavy chain variable region amino acid sequence (SEQ ID NO:173)
QVQLQESGPGLVKPSQTLSLNCTVSGGSISSGGYYWSWIRQHPGKGLEWIGYIHYSGSTYYNPSLKSRITISADTSKNQFSLKLNSVTA
                   CDR1                              CDR2
ADTAVYYCARDRGGGDYGRMDVWGQGTTVTVSS
            CDR3

FIGURE 2J

U-V<sub>H</sub>-41 heavy chain variable region amino acid sequence (SEQ ID NO:174)
QVQLQESGPGLVKPSQTLSLTCTVSGGSISSGGYYWSWIRQHPGKGLEWIGYIHSSGSTYYNPSLKSRITKSVDTSKNQFSLKLSSVTA
                                      CDR1                                      CDR2

ADTAVYYCARSNNYGCFALWGRGTLVTVSS
       CDR3

U-V<sub>H</sub>-42 heavy chain variable region amino acid sequence (SEQ ID NO:175)
QVQLQESGPGLVKPSQTLSLTCTVSGGSISSGGYYWSWIRQHPGKGLEWIGYIHSSGSTYYNPSLKSRITKSVDTSKNQFSLKLSSVTA
                                      CDR1                                      CDR2

ADTAVYYCARSNNYGCFALWGRGTLVTVSS
       CDR3

U-V<sub>H</sub>-43 heavy chain variable region amino acid sequence (SEQ ID NO:176)
QVQLQESPGLVKPSQTLSLTCTVSGGSISSGGYYWSWIRQHPGKGLEWIGYIHYSGSTYYNPSLKSRVTISVDTSKNQFSLKLSSVTA
                                      CDR1                                      CDR2

ADTAVYYCASGYNYGLYYYDSSGYPSYYYGMDVWGQGTTVTVSS
                   CDR3

U-V<sub>H</sub>-44 heavy chain variable region amino acid sequence (SEQ ID NO:177)
QVQLQESGPGLVKPSQTLSLTCTVSGGSISSGDYYWNWVRQHPGKGLEWIGIYYSGGTYYNPSLKSRVTISVDTSKNQFSLKLFSVTA
                                      CDR1                                      CDR2

ADTAVYFCARTYYDILTGYPFYFDYWGQGTLVTVSS
         CDR3

FIGURE 2K

U-V<sub>H</sub>-45 heavy chain variable region amino acid sequence (SEQ ID NO:178)
QVQLQESGPGLVKPSQTLSLTCTVSGGSISSGDYYWNWVRQHPGKGLEWIGYIYYSGGTYYNPSLKSRVTISVDTSKNQFSLKLFSVTA
                                   CDR1                                      CDR2

ADTAVYFCARTYYDILTGYPFYFDYWGQGTLVTVSS
         CDR3

U-V<sub>H</sub>-46 heavy chain variable region amino acid sequence (SEQ ID NO:179)
QVQLQQWGAGLLKPSETLSLTCAVYGGSFSGYYWSWIRQPPGKGLEWIGEINHSGSTNYNPSLKSRVTISVDTSKNQFSLKLSSVTAAD
                                      CDR1                                CDR2

TAVYYCARGGYSSSWYWFDPWGQGTLVTVSS
       CDR3

U-V<sub>H</sub>-47 heavy chain variable region amino acid sequence (SEQ ID NO:180)
QVQLQQWGAGLLKPSETLSLTCAVYGGSFSGYYWSWIRQPPGKGLEWIGEINHSGSTNYNPSLKSRVTISVDTSKNQFSLKLSSVTAAD
                                      CDR1                                CDR2

TAVYYCARGGYSSSWFWFDPWGQGTLVTVSS
       CDR3

U-V<sub>H</sub>-48 heavy chain variable region amino acid sequence (SEQ ID NO:180)
QVQLQQWGAGLLKPSETLSLTCAVYGGSFSGYYWSWIRQPPGKGLEWIGEINHSGSTNYNPSLKSRVTISVDTSKNQFSLKLSSVTAAD
                                      CDR1                                CDR2

TAVYYCARGGYSSSWFWFDPWGQGTLVTVSS
       CDR3

FIGURE 2L

U-V$_H$-49 heavy chain variable region amino acid sequence (SEQ ID NO:180)
QVQLQQWGAGLLKPSETLSLTCAVYGGSFSGYYWSWIRQPPGKGLEWIGEINHSGSTNYNPSLKSRVTISVDTSKNQFSLKLSSVTAAD
<u>CDR1</u>                                   <u>CDR2</u>

TAVYYCARGGYSSSWFWFDPWGQGTLVTVSS
        <u>CDR3</u>

U-V$_H$-50 heavy chain variable region amino acid sequence (SEQ ID NO:180)
QVQLQQWGAGLLKPSETLSLTCAVYGGSFSGYYWSWIRQPPGKGLEWIGEINHSGSTNYNPSLKSRVTISVDTSKNQFSLKLSSVTAAD
<u>CDR1</u>                                   <u>CDR2</u>

TAVYYCARGGYSSSWFWFDPWGQGTLVTVSS
       <u>CDR3</u>

U-V$_H$-51 heavy chain variable region amino acid sequence (SEQ ID NO:181)
QVQLQESGPGLVKPSETLSLTCTVSGGSISSYYWSWIRQPAGKGLEWIGRIYTSGTTNYNPSLKSRVTMSVDTSKNQFSLKLSSVTAAD
<u>CDR1</u>                                   <u>CDR2</u>

TAVYYCARDGYSYGHYYYYGMDVWGQGTTVTVSS
      <u>CDR3</u>

U-V$_H$-52 heavy chain variable region amino acid sequence (SEQ ID NO:182)
QVQLQESGPGLVKPSETLSLTCTVSGGSVSSGGSYWSWIRQPPGKGLEWIGIYYSGSTNYNPSLKSRVTISIVTSRNQFSLKLSSVTA
<u>CDR1</u>                                   <u>CDR2</u>

ADTAVYYCARSALRYFDWLFSDVSDIWGQGTMVTVSS
         <u>CDR3</u>

FIGURE 2M

U-V_H-53 heavy chain variable region amino acid sequence (SEQ ID NO:182)
QVQLQESGPGLVKPSETLSLTCTVSGGSVSSGGSYWSWIRQPPGKGLEWIGYIYYSGSTNYNPSLKSRVTISIVTSRNQFSLKLSSVTA
　　　　　　　　　　　　　　　　　　　CDR1　　　　　　　　　　　　　　　　CDR2
ADTAVYYCARSALRYFDWLFSDVSDIWGQGTMVTVSS
　　　　　　　CDR3

U-V_H-54 heavy chain variable region amino acid sequence (SEQ ID NO:183)
EVQLVQSGAELKKPGESLKISCKGSGYRFTSYWIGWVRQMPGKGLEWMGIIYPDDSDTRYSPSFQGQVTISADKSISTAYLQWSSLKAS
　　　　　　　　　　　　　　　　CDR1　　　　　　　　　　　　　　CDR2
DTAMYYCARQKSYGYSYFDYWGQGTLVTVSS
　　　　　　CDR3

U-V_H-55 heavy chain variable region amino acid sequence (SEQ ID NO:184)
EVQLVQSGAEVKKPGESLKISCKGSGYSFTSYWIGWVRQMPGKGLEWMGIIYPDDSDARYSPSFQGQVTISADKSINTAYLQWSSLKAS
　　　　　　　　　　　　　　　　CDR1　　　　　　　　　　　　　　CDR2
DTAMYYCARQGYGSGWGYFDYWGQGTLVTVSS
　　　　　　CDR3

U-V_H-56 heavy chain variable region amino acid sequence (SEQ ID NO:185)
EVQLVQSGAEVKKPGESLKISCKGSGYSFTSYWIGWVRQMPGKGLEWMGIIYPGDSDIRYSPSFQGQVTISADKSISTAYLQWSSLKAS
　　　　　　　　　　　　　　　　CDR1　　　　　　　　　　　　　　CDR2
DTAMYYCARQGLAVAGTSYYYYGMDVWGQGTTVTVSS
　　　　　　　CDR3

FIGURE 2N

U-V$_H$-57 heavy chain variable region amino acid sequence (SEQ ID NO:186)
QVQLQQSGPGLVKPSQTLSLTCAISGDSVSSYSAAWNWIRQSPSRGLEWLGRTYCRSKWYNDYAVSVKSRITINPDTSKNQFSLQLNSV
　　　　　　　　　　　　　　　　　CDR1　　　　　　　　　　　　　　　　　　　CDR2

TPEDTAVYYCARDRAVAGYYYGMDVWGQGTTVTVSS
　　　　　　CDR3

U-V$_H$-58 heavy chain variable region amino acid sequence (SEQ ID NO:166)
EVQLVESGGGLVQPGGSLRLSCAASGFTFSAYSMNWVRQAPGKGLEWVSYISSSGRTIYYADSVKGRFTISRDNAKNSLFLQMNSLRDE
　　　　　　　　　　　　　　　CDR1　　　　　　　　　　　　　　　CDR2

DTAVYYCALWAPFDYWGQGTLVTVSS
　　　　CDR3

FIGURE 2O

U$_L$-1 light chain amino acid sequence (SEQ ID NO:1)
DVVMTQSPLSLPVTLGQPASISCRSSQSLVYSDGNTYLNWFQQRPGQSPRRLIYKVSNWDSGVP
DRFNGSGSGTDFTLKISRVEAEDVGVYYCMQSTHWPITFGQGTRLEIKRTVAAPSVFIFPPSDE
QLKSGTASVVCLLNNFYPREAKVQWKVDNALQSGNSQESVTEQDSKDSTYSLSSTLTLSKADYE
KHKVYACEVTHQGLSSPVTKSFNRGEC

U$_L$-2 light chain amino acid sequence (SEQ ID NO:2)
DVVMTQSPLSLPVTLGQPASISCRSSQSLVYSDGNTYLNWFQQRPGQSPRRLIYKVSNWDSGVP
DRFSGSGSGTDFTLKISRVEAEDVGVYYCIQGTHWPTTFGQGTRLEIKRTVAAPSVFIFPPSDE
QLKSGTASVVCLLNNFYPREAKVQWKVDNALQSGNSQESVTEQDSKDSTYSLSSTLTLSKADYE
KHKVYACEVTHQGLSSPVTKSFNRGEC

U$_L$-3 light chain amino acid sequence (SEQ ID NO:3)
DVVMTQSPLSLPVTLGQPASISCRSSQSLVYSDGNTYLNWLQQRPGQSPRRLIYKVSNWDSGVP
DRFSGSGSGTDFTLKISRVEAEDVGVYYCMQGTHWPITFGQGTRLEIKRTVAAPSVFIFPPSDE
QLKSGTASVVCLLNNFYPREAKVQWKVDNALQSGNSQESVTEQDSKDSTYSLSSTLTLSKADYE
KHKVYACEVTHQGLSSPVTKSFNRGEC

U$_L$-4 light chain amino acid sequence (SEQ ID NO:3)
DVVMTQSPLSLPVTLGQPASISCRSSQSLVYSDGNTYLNWLQQRPGQSPRRLIYKVSNWDSGVP
DRFSGSGSGTDFTLKISRVEAEDVGVYYCMQGTHWPITFGQGTRLEIKRTVAAPSVFIFPPSDE
QLKSGTASVVCLLNNFYPREAKVQWKVDNALQSGNSQESVTEQDSKDSTYSLSSTLTLSKADYE
KHKVYACEVTHQGLSSPVTKSFNRGEC

U$_L$-5 light chain amino acid sequence (SEQ ID NO:4)
DIVMTQTPLSLSVTPGQPASISCKSSQSLLHSDGKTYLYWYLQKPGQPPQLLIYEVSNRFSGVP
DRFSGSGSGTDFTLKISRVEAEDVGVYYCMQGIQLPCSFGQGTKLEIKRTVAAPSVFIFPPSDE
QLKSGTASVVCLLNNFYPREAKVQWKVDNALQSGNSQESVTEQDSKDSTYSLSSTLTLSKADYE
KHKVYACEVTHQGLSSPVTKSFNRGEC

U$_L$-6 light chain amino acid sequence (SEQ ID NO:5)
DIVMTQTPLSLSVTPGQPASISCKSSQSLLHSDGKTYLYWYLQKPGQPPQLLIYEVSNRFSGVP
DRFSGSGSGTDFTLKISRVEAEDVGVYYCMQSIQLPLTFGGGTKVEIKRTVAAPSVFIFPPSDE
QLKSGTASVVCLLNNFYPREAKVQWKVDNALQSGNSQESVTEQDSKDSTYSLSSTLTLSKADYE
KHKVYACEVTHQGLSSPVTKSFNRGEC

FIGURE 3A

U<sub>L</sub>-7 light chain amino acid sequence (SEQ ID NO:5)
DIVMTQTPLSLSVTPGQPASISCKSSQSLLHSDGKTYLYWYLQKPGQPPQLLIYEVSNRFSGVP
DRFSGSGSGTDFTLKISRVEAEDVGVYYCMQSIQLPLTFGGGTKVEIKRTVAAPSVFIFPPSDE
QLKSGTASVVCLLNNFYPREAKVQWKVDNALQSGNSQESVTEQDSKDSTYSLSSTLTLSKADYE
KHKVYACEVTHQGLSSPVTKSFNRGEC

U<sub>L</sub>-8 light chain amino acid sequence (SEQ ID NO:6)
DIVMTQTPLSLSVTPGQPASISCKSSQSLLHSDGKTYLYWFLQKPGQPPQPLIYEVSNRFSGVP
DRFSGSGSGTDFTLKISRVEAEDVGVYYCMQSIQLPITFGHGTRLEIKRTVAAPSVFIFPPSDE
QLKSGTASVVCLLNNFYPREAKVQWKVDNALQSGNSQESVTEQDSKDSTYSLSSTLTLSKADYE
KHKVYACEVTHQGLSSPVTKSFNRGEC

U<sub>L</sub>-9 light chain amino acid sequence (SEQ ID NO:6)
DIVMTQTPLSLSVTPGQPASISCKSSQSLLHSDGKTYLYWFLQKPGQPPQPLIYEVSNRFSGVP
DRFSGSGSGTDFTLKISRVEAEDVGVYYCMQSIQLPITFGHGTRLEIKRTVAAPSVFIFPPSDE
QLKSGTASVVCLLNNFYPREAKVQWKVDNALQSGNSQESVTEQDSKDSTYSLSSTLTLSKADYE
KHKVYACEVTHQGLSSPVTKSFNRGEC

U<sub>L</sub>-11 light chain amino acid sequence (SEQ ID NO:7)
DIQMTQSPSSLSASVGDRVTITCRASQGIANYLAWYQQKPGKVPKLLIYVASTLQSGVPSRFSG
SGSGTDFTLTISSLQPEDVATYYCQNYNSAPFTFGPGTKVDIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-12 light chain amino acid sequence (SEQ ID NO:8)
DIQMTQSPSSLSASVGDRVTIICRASQGISNDLAWYQQKPGKVPKLLIYAASTLQSGVPSRFSG
SGSGTDFTLTISSLQPEDVATYYCQKYNSVPLTFGGGTKVEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-13 light chain amino acid sequence (SEQ ID NO:9)
NIVMTQTPLSSPVTLGQPASISCRSSQSLVHSDGNTYLSWLQQRPGQPPRLLIYKISNRFSGVP
DRFSGSGAGTDFTLKISRVEAEDVGVYYCMQATQFPHTFGPGTKVDIKRTVAAPSVFIFPPSDE
QLKSGTASVVCLLNNFYPREAKVQWKVDNALQSGNSQESVTEQDSKDSTYSLSSTLTLSKADYE
KHKVYACEVTHQGLSSPVTKSFNRGEC

FIGURE 3B

U<sub>L</sub>-14 light chain amino acid sequence (SEQ ID NO:9)
NIVMTQTPLSSPVTLGQPASISCRSSQSLVHSDGNTYLSWLQQRPGQPPRLLIYKISNRFSGVP
DRFSGSGAGTDFTLKISRVEAEDVGVYYCMQATQFPHTFGPGTKVDIKRTVAAPSVFIFPPSDE
QLKSGTASVVCLLNNFYPREAKVQWKVDNALQSGNSQESVTEQDSKDSTYSLSSTLTLSKADYE
KHKVYACEVTHQGLSSPVTKSFNRGEC

U<sub>L</sub>-15 light chain amino acid sequence (SEQ ID NO:10)
EIVMTQTPLSSPVTLGQPASISCRSSQSLVHSDGNTYLSWLQQRPGQPPRLLIYKISNRFSGVP
DRFSGTGAGTDFTLKISRVEAEDVGVYYCMQATQFPHTFGGGTKVEIKRTVAAPSVFIFPPSDE
QLKSGTASVVCLLNNFYPREAKVQWKVDNALQSGNSQESVTEQDSKDSTYSLSSTLTLSKADYE
KHKVYACEVTHQGLSSPVTKSFNRGEC

U<sub>L</sub>-16 light chain amino acid sequence (SEQ ID NO:11)
EIVLTQSPGTLSLSPGERATLSCRASQTVISSYLAWYQQKPGQAPRLLISGASSRATGIPDRFS
GSGSGTDFTLTISRLEPEDFAVYYCQQYGSSPRTFGQGTKVEIKRTVAAPSVFIFPPSDEQLKS
GTASVVCLLNNFYPREAKVQWKVDNALQSGNSQESVTEQDSKDSTYSLSSTLTLSKADYEKHKV
YACEVTHQGLSSPVTKSFNRGEC

U<sub>L</sub>-17 light chain amino acid sequence (SEQ ID NO:12)
EIVLTQSPGTLSLSPGERATLSCRASQSVSRLAWYQQKPGQAPRLLIYGASRRATGIPDRFSGS
GSGTDFTLTISRLEPEDFAVYYCQQYGSSPRSFGQGTKLEIKRTVAAPSVFIFPPSDEQLKSGT
ASVVCLLNNFYPREAKVQWKVDNALQSGNSQESVTEQDSKDSTYSLSSTLTLSKADYEKHKVYA
CEVTHQGLSSPVTKSFNRGEC

U<sub>L</sub>-18 light chain amino acid sequence (SEQ ID NO:13)
DIQMTQSPSSLSASVGDRVTITCRASQGIRNDLGWYQQKPGKAPKRLIYAASSLQSGVPSRFSG
SGSGTEFTLTISSLQPEDFATYYCLQHNSYPPTFGQGTKVEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-19 light chain amino acid sequence (SEQ ID NO:14)
DIVMTQSPDSLAVSLGERATINCKSSQSVLYSSNNKNYLVWYQQKPGQPPKLFIYWASTRESGV
PDRFTGSGSGTDFTLTISSLQAEDVAVYYCQQYYSFPWTFGQGTKVEIKRTVAAPSVFIFPPSD
EQLKSGTASVVCLLNNFYPREAKVQWKVDNALQSGNSQESVTEQDSKDSTYSLSSTLTLSKADY
EKHKVYACEVTHQGLSSPVTKSFNRGEC

FIGURE 3C

U<sub>L</sub>-20 light chain amino acid sequence (SEQ ID NO:14)
DIVMTQSPDSLAVSLGERATINCKSSQSVLYSSNNKNYLVWYQQKPGQPPKLFIYWASTRESGV
PDRFTGSGSGTDFTLTISSLQAEDVAVYYCQQYYSFPWTFGQGTKVEIKRTVAAPSVFIFPPSD
EQLKSGTASVVCLLNNFYPREAKVQWKVDNALQSGNSQESVTEQDSKDSTYSLSSTLTLSKADY
EKHKVYACEVTHQGLSSPVTKSFNRGEC

U<sub>L</sub>-21 light chain amino acid sequence (SEQ ID NO:15)
DIVMTQSPDSLAVSLGERATINCKSSQSVLYSSNNKNYLAWYQQKPGQPPKLLIYWASTRESGV
PDRFSGSGSGTDFTLTISSLQAEDVAVYYCQQYYSTTWTFGQGTKVEIKRTVAAPSVFIFPPSD
EQLKSGTASVVCLLNNFYPREAKVQWKVDNALQSGNSQESVTEQDSKDSTYSLSSTLTLSKADY
EKHKVYACEVTHQGLSSPVTKSFNRGEC

U<sub>L</sub>-22 light chain amino acid sequence (SEQ ID NO:16)
DIVMTQSPDSLAVSLGERATINCKSSQNVLYSSNNKNYLAWYQQKPGQPPKLLIYWASTRESGV
PDRFSGSGSGTDFTLTISSLQAEDVAVYFCQQYYGTPRTFGQGTKVEIKRTVAAPSVFIFPPSD
EQLKSGTASVVCLLNNFYPREAKVQWKVDNALQSGNSQESVTEQDSKDSTYSLSSTLTLSKADY
EKHKVYACEVTHQGLSSPVTKSFNRGEC

U<sub>L</sub>-23 light chain amino acid sequence (SEQ ID NO:17)
DIVMTQSPDSLAVSLGERATINCKSSQNVLYSSNNKNYLAWYQQKPGQPPKLLIYWASTRESGV
PDRFSGSGSGTDFTLTISSLQAEDVAVYFCQQYYGTPRTFGQGTKVEIKRTVAAPSVFIFPPSD
EQLKSGTASVVCLLNNFYPREAKVQWKVDNALQSGNSQESVTEQDSKDSTYSLSSTLTLSKADY
EKHKVYACEVTHQGLSSPVTKSFNRGEC

U<sub>L</sub>-24 light chain amino acid sequence (SEQ ID NO:18)
DIVMTQSPDSLTVSLGERATINCKSSQSVLYSSNNKNYLAWYQQKPGQPPKLLIYWASTRESGV
PDRFGGSGSGTDFTLTISSLQAEDVAVYYCQQYYSISRTFGQGTKVEIKRTVAAPSVFIFPPSD
EQLKSGTASVVCLLNNFYPREAKVQWKVDNALQSGNSQESVTEQDSKDSTYSLSSTLTLSKADY
EKHKVYACEVTHQGLSSPVTKSFNRGEC

U<sub>L</sub>-25 light chain amino acid sequence (SEQ ID NO:18)
DIVMTQSPDSLTVSLGERATINCKSSQSVLYSSNNKNYLAWYQQKPGQPPKLLIYWASTRESGV
PDRFGGSGSGTDFTLTISSLQAEDVAVYYCQQYYSISRTFGQGTKVEIKRTVAAPSVFIFPPSD
EQLKSGTASVVCLLNNFYPREAKVQWKVDNALQSGNSQESVTEQDSKDSTYSLSSTLTLSKADY
EKHKVYACEVTHQGLSSPVTKSFNRGEC

FIGURE 3D

U<sub>L</sub>-26 light chain amino acid sequence (SEQ ID NO:19)
DIVMTQSPDSLAVSLGERATINCKSSQSVLYNSNNKNYLAWYQQKPGQPPKLLIYWASTRESGV
PDRFSGSGSGTDFTLTISSLQADDVAVYYCQQYYSTTWTFGPGTKVEIKRTVAAPSVFIFPPSD
EQLKSGTASVVCLLNNFYPREAKVQWKVDNALQSGNSQESVTEQDSKDSTYSLSSTLTLSKADY
EKHKVYACEVTHQGLSSPVTKSFNRGEC U<sub>L</sub>-27 light chain amino acid sequence (SEQ ID NO:20)
DIVMTQSPDSLAVSLGERATINCKSSQSVLYNSNNKNYLAWYQQKPGQPPKLLIYWASTRESGV
PDRFSGSGSGTDFTLTISSLQADDVAVYYCQQYYSTTWTFGPGTKVEIKRTVAAPSVFIFPPSD
EQLKSGTASVVCLLNNFYPREAKVQWKVDNALQSGNSQESVTEQDSKDSTYSLSSTLTLSKADY
EKHKVYACEVTHQGLSSPVTKSFNRGEC U<sub>L</sub>-28 light chain amino acid sequence (SEQ ID NO:21)
DIVMTQSPDSLAVSLGERATINCKSSQSVLYSSNNKNYLAWYQQKPGQPPKVLIYWASTRKSGV
PDRFSGSGSGTDFTLTISGLQAEDVALYYCQQYYSTMFSFGQGTKLEIKRTVAAPSVFIFPPSD
EQLKSGTASVVCLLNNFYPREAKVQWKVDNALQSGNSQESVTEQDSKDSTYSLSSTLTLSKADY
EKHKVYACEVTHQGLSSPVTKSFNRGEC U<sub>L</sub>-29 light chain amino acid sequence (SEQ ID NO:21)
DIVMTQSPDSLAVSLGERATINCKSSQSVLYSSNNKNYLAWYQQKPGQPPKVLIYWASTRKSGV
PDRFSGSGSGTDFTLTISGLQAEDVALYYCQQYYSTMFSFGQGTKLEIKRTVAAPSVFIFPPSD
EQLKSGTASVVCLLNNFYPREAKVQWKVDNALQSGNSQESVTEQDSKDSTYSLSSTLTLSKADY
EKHKVYACEVTHQGLSSPVTKSFNRGEC U<sub>L</sub>-30 light chain amino acid sequence (SEQ ID NO:22)
DIVMTQSPDSLAVSLGERATINCKSSQSVLDSSNNKNYLAWYQQKPGQPPKLLIYWASTRESGV
PDRFSGSGSGTDFTLTISSLQAEDVAVFYCHQYYSTPLTFGGGTKVAIKRTVAAPSVFIFPPSD
EQLKSGTASVVCLLNNFYPREAKVQWKVDNALQSGNSQESVTEQDSKDSTYSLSSTLTLSKADY
EKHKVYACEVTHQGLSSPVTKSFNRGEC U<sub>L</sub>-31 light chain amino acid sequence (SEQ ID NO:22)
DIVMTQSPDSLAVSLGERATINCKSSQSVLDSSNNKNYLAWYQQKPGQPPKLLIYWASTRESGV
PDRFSGSGSGTDFTLTISSLQAEDVAVFYCHQYYSTPLTFGGGTKVAIKRTVAAPSVFIFPPSD
EQLKSGTASVVCLLNNFYPREAKVQWKVDNALQSGNSQESVTEQDSKDSTYSLSSTLTLSKADY
EKHKVYACEVTHQGLSSPVTKSFNRGEC

FIGURE 3E

U<sub>L</sub>-32 light chain amino acid sequence (SEQ ID NO:23)
DIVMTQSPDSLAVSLGERATINCKSSQSILYRSNNKNYLAWYQQKPGQPPKLLIYWASARESGV
PDRFSGSGSGTDFTLTISSLQAEDVAVYFCQQYFITPLTFGGGTKVEIKRTVAAPSVFIFPPSD
EQLKSGTASVVCLLNNFYPREAKVQWKVDNALQSGNSQESVTEQDSKDSTYSLSSTLTLSKADY
EKHKVYACEVTHQGLSSPVTKSFNRGEC U<sub>L</sub>-33 light chain amino acid sequence (SEQ ID NO:23)
DIVMTQSPDSLAVSLGERATINCKSSQSILYRSNNKNYLAWYQQKPGQPPKLLIYWASARESGV
PDRFSGSGSGTDFTLTISSLQAEDVAVYFCQQYFITPLTFGGGTKVEIKRTVAAPSVFIFPPSD
EQLKSGTASVVCLLNNFYPREAKVQWKVDNALQSGNSQESVTEQDSKDSTYSLSSTLTLSKADY
EKHKVYACEVTHQGLSSPVTKSFNRGEC U<sub>L</sub>-34 light chain amino acid sequence (SEQ ID NO:24)
DIQMTQSPSSLSASVGDRVTITCRASQDISHYLAWFQQKPGKAPKSLIYAASSLQSGVPSKFSG
SGSGTDFTLTISSLQPEDFATYYCQQYNNYPFTFGPGTKVDIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC U<sub>L</sub>-35 light chain amino acid sequence (SEQ ID NO:25)
DIQMTQSPSSLSASVGDRVAITCRASQDISNYLAWLQQKPGKAPKSLIYAASSLQSGVPSRFSG
SGSGTDFTLTISSLQPEDFATYYCQQYNTYPFTFGPGTKMDIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC U<sub>L</sub>-36 light chain amino acid sequence (SEQ ID NO:26)
EIVMTQSPATLSVSPGERATLSCRASQSVSSNLAWYQQDPGQAPRLLIYGASRRATGIPARFSG
SGSGTEFTLTISSLQSEDFAVYYCQQHNNWPWTFGQGTKVEIKRTVAAPSVFIFPPSDEQLKS
GTASVVCLLNNFYPREAKVQWKVDNALQSGNSQESVTEQDSKDSTYSLSSTLTLSKADYEKHKV
YACEVTHQGLSSPVTKSFNRGEC U<sub>L</sub>-37 light chain amino acid sequence (SEQ ID NO:26)
EIVMTQSPATLSVSPGERATLSCRASQSVSSNLAWYQQDPGQAPRLLIYGASRRATGIPARFSG
SGSGTEFTLTISSLQSEDFAVYYCQQHNNWPWTFGQGTKVEIKRTVAAPSVFIFPPSDEQLKS
GTASVVCLLNNFYPREAKVQWKVDNALQSGNSQESVTEQDSKDSTYSLSSTLTLSKADYEKHKV
YACEVTHQGLSSPVTKSFNRGEC

FIGURE 3F

U<sub>L</sub>-38 light chain amino acid sequence (SEQ ID NO:27)
DIQMTQSPSSVSASVGDRVTITCRASQDISRWLAWYQQKPGKAPKLLIYAASSLQSGVPSRFSG
SGSGTDFTLTISSLQPEDFATYYCQQANSFPPTFGQGTKVEFKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-39 light chain amino acid sequence (SEQ ID NO:28)
DIQMTQSPSSLSASVGDRVTITCRASQSISTYLNWYQQKPGKAPKFLIYAASSLQSGVPSRFSG
SGSGTDFTLTISSLQPEDFAAYYCQQSHSAPFTFGPGTKVDIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-40 light chain amino acid sequence (SEQ ID NO:29)
DIQMTQSPSSLSASLGDRVTITCRASQTISIYLNWYQQKPGKAPKLLIYAASSLQSGVPSRFSG
SGSGTDFTLTISSLQPEDFATYYCQQSYSTLTFGGGTKVEIKRTVAAPSVFIFPPSDEQLKSGT
ASVVCLLNNFYPREAKVQWKVDNALQSGNSQESVTEQDSKDSTYSLSSTLTLSKADYEKHKVYA
CEVTHQGLSSPVTKSFNRGEC

U<sub>L</sub>-41 light chain amino acid sequence (SEQ ID NO:30)
DIQMTQSPSSLSASVGDRVTITCRASQSIRSYLNWYQQRPGNAPKLLIYAASSLQSGVPSRVSG
SGSGTDFTLTIRSLQPEDFATYYCQQSYSIPLTFGGGTKVEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-42 light chain amino acid sequence (SEQ ID NO:31)
DIQMTQSPSSRSASVGDRVTITCRASQTISRYLNWYQQKPGKAPKLLIYAASTLQSGVPSRFSG
SGSGTDFTLTLSSLQPEDFATYYCQQIYSTSITFGQGTRLEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-43 light chain amino acid sequence (SEQ ID NO:32)
DIQMTQSPSSLSASVGDRVTITCRASQRISSYLNWYQQKPGKAPKVLIYAESSLQSGVPSRFSG
SGSGTDFTLTISSLQPEDFATYYCQQSYITPITFGQGTRLEIIRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

FIGURE 3G

U$_L$-44 light chain amino acid sequence (SEQ ID NO:33)
DIQMTQSPSSLSASVGDRVTITCRASQSISRYLNWYQQKPGKAPKLLIYTASSLQSGVPSRFSG
SGSGTDFTLTISSLQPENFATYYCQQSYFTPITFGQGTRLEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U$_L$-45 light chain amino acid sequence (SEQ ID NO:34)
DIQMTQSPSSLSASVGDRVTITCRASQSISSYLNWYQQKPGKAPKLLIYTASSLQSGVPSRFSG
SGSGTDFTLTFSSLQPEDFATYYCQQSYFSPITFGQGTRLEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U$_L$-46 light chain amino acid sequence (SEQ ID NO:35)
DIQMTQSPSSLSASVGDRVTITCRASQSISSYLNWYQQKPGKAPKLLIYTASSLQSGVPSRFSG
SGSGTDFTLTLSSLQPEDFASYYCQQSFYTPITFGQGTRLEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U$_L$-47 light chain amino acid sequence (SEQ ID NO:35)
DIQMTQSPSSLSASVGDRVTITCRASQSISSYLNWYQQKPGKAPKLLIYTASSLQSGVPSRFSG
SGSGTDFTLTLSSLQPEDFASYYCQQSFYTPITFGQGTRLEIKASTKGPSVFPLAPCSRSTSES
TAALGCLVKDYFPEPVTVSWNSGALTSGVHTFPAVLQSSGLYSLSSVVTVPSSNFGTQTYTCNV
DHKPSNTKVDKTVERKCCVECPPCPAPPVAGPSVFLFPPKPKDTLMISRTPEVTCVVVDVSHED
PEVQFNWYVDGVEVHNAKTKPREEQFNSTFRVVSVLTVVHQDWLNGKEYKCKVSNKGLPAPIEK
TISKTKGQPREPQVYTLPPSREEMTKNQVSLTCLVKGFYPSDIAVEWESNGQPENNYKTTPPML
DSDGSFFLYSKLTVDKSRWQQGNVFSCSVMHEALHNHYTQKSLSLSPGK

U$_L$-48 light chain amino acid sequence (SEQ ID NO:36)
DIQMTQSPSSLSASVGDRVTITCRASQSISSYLNWYQQKPGKAPKLLIYTVSSLQSGVPSRFSG
SGSGTDFTLTISSLQPEDFATYYCQQSYFTPITFGQGTRLEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U$_L$-49 light chain amino acid sequence (SEQ ID NO:36)
DIQMTQSPSSLSASVGDRVTITCRASQSISSYLNWYQQKPGKAPKLLIYTVSSLQSGVPSRFSG
SGSGTDFTLTISSLQPEDFATYYCQQSYFTPITFGQGTRLEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

FIGURE 3H

U<sub>L</sub>-50 light chain amino acid sequence (SEQ ID NO:36)
DIQMTQSPSSLSASVGDRVTITCRASQSISSYLNWYQQKPGKAPKLLIYTVSSLQSGVPSRFSG
SGSGTDFTLTISSLQPEDFATYYCQQSYFTPITFGQGTRLEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-51 light chain amino acid sequence (SEQ ID NO:37)
DIQMTQSPSSLSASVGDRVTITCRASQSISSYLNWYQQKPGKAPKLLIYTASSLQSGVPSRFSG
SGSGTDFTLTISSLQPEDFASYYCQQSFYAPITFGQGTRLEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-52 light chain amino acid sequence (SEQ ID NO:37)
DIQMTQSPSSLSASVGDRVTITCRASQSISSYLNWYQQKPGKAPKLLIYTASSLQSGVPSRFSG
SGSGTDFTLTISSLQPEDFASYYCQQSFYAPITFGQGTRLEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-53 light chain amino acid sequence (SEQ ID NO:38)
DIQMTQSPSSLSASVGDRVTITCRASQSISSYLNWYQQKPGKAPKLLIYTASSLQSGVPSRFSG
SGSGTDFTLTISSLQPEDFATYYCQQSYFTPITFGQGTRLEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-54 light chain amino acid sequence (SEQ ID NO:39)
DIQMTQSPSSLSASVGDRVTITCQASQDISNYLNWYQQKPGKAPKLLIYDASNLETGVPSRFSG
SGSGTDFTFTISSLQPEDIATYYCQQYDYLPFTFGPGTKVDIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-55 light chain amino acid sequence (SEQ ID NO:39)
DIQMTQSPSSLSASVGDRVTITCQASQDISNYLNWYQQKPGKAPKLLIYDASNLETGVPSRFSG
SGSGTDFTFTISSLQPEDIATYYCQQYDYLPFTFGPGTKVDIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

FIGURE 3I

U<sub>L</sub>-56 light chain amino acid sequence (SEQ ID NO:40)
DIQMTQSPSSLSASVGDRVTITCQASQDISNSLNWYQQKPGKAPELLIYDASNLETGVPSRFSG
SGSGTDFTFTISSLQPEDIATYYCQQCDDLPLTFGGGTKVEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-57 light chain amino acid sequence (SEQ ID NO:41)
DIQMTQSPSSLSASVGDRVTITCQASQDISDYLNWYQQKPGKAPKLLIYDASNLETGVPSRFSG
SGSGTDFTFTISSLQPEDIATYYCQHYDNLPLTFGGGTKVEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-58 light chain amino acid sequence (SEQ ID NO:42)
DIQMTQSPSSLSASVGDRVAITCQASQDISNYLNWYQQKPGKAPKLLIYDASNLETGVPSRFSG
SGSGTDFTFTISSLQPEDIATYYCQQYDNLPLTFGGGTKVEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-59 light chain amino acid sequence (SEQ ID NO:42)
DIQMTQSPSSLSASVGDRVAITCQASQDISNYLNWYQQKPGKAPKLLIYDASNLETGVPSRFSG
SGSGTDFTFTISSLQPEDIATYYCQQYDNLPLTFGGGTKVEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-60 light chain amino acid sequence (SEQ ID NO:43)
DIQMTQSPSSLSASVGDRVTITCQASQDISNSLNWYQQKPGKAPKLLIYDASILETGVPSRFSG
SGSETDFTFTISSLQPEDIATYYCQQCDILPLSFGGGTKVEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U<sub>L</sub>-61 light chain amino acid sequence (SEQ ID NO:44)
DIQMTQSPSSLSASVGDRVTITCQASQDISNSLNWYQQKPGKAPKLLIYDASNLETGVPSRFSG
SGSGTDFTFTISSLQPEDIATYYCQQYDNLPLAFGGGTKVEIRRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

FIGURE 3J

U$_L$-62 light chain amino acid sequence (SEQ ID NO:45)
DIQMTQSPSSLSASVGDGVTITCQASQDITNYLNWYQQKPGKAPKLLIYDASNLETGVPSRFSG
SGSGTDFTFTISSLQPEDIATYYCQQYDSLPITFGQGTRLEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U$_L$-63 light chain amino acid sequence (SEQ ID NO:46)
DIQMTQSPSSLSASVGDRVTITCQASQDISNYLNWYQQKLGKAPKLLIHDASNLETGVPSRFSG
SGSGTDFTFTISSLQPEDIATYYCQQYDNLPITFGQGTRLEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U$_L$-64 light chain amino acid sequence (SEQ ID NO:47)
DIQMTQSPSSLSASVGDRVTITCQASQDISDYLNWYQQKPGKAPKLLIYDASNLETGVPSRFSG
SGSGTDFTFTISSLQPEDIATYYCQHYDNLPITFGQGTRLEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

U$_L$-65 light chain amino acid sequence (SEQ ID NO:48)
DIQMTQSPSSLSASVGDRVTITCQASQDISNSLNWYQQKPGKAPKLLIYDASNLETGVPSRFSG
SGSGTDFTFTISSLQPEDIATYYCQHYDNLPITFGQGTRLEIKRTVAAPSVFIFPPSDEQLKSG
TASVVCLLNNFYPREAKVQWKVDNALQSGNSQESVTEQDSKDSTYSLSSTLTLSKADYEKHKVY
ACEVTHQGLSSPVTKSFNRGEC

FIGURE 3K

U<sub>B</sub>-1 heavy chain amino acid sequence (SEQ ID NO:49)
QVQLVQSGAEVKKPGASVKVSCKASGYTFTSYGISWVRQAPGQGLEWMGWISASNGNTNYAQKL
QDRVTMTTDTSTSTAYMELRSLRSDDTAVYYCAREDNWNYGFFDYWGQGTLVTVSSASTKGPSV
FPLAPCSRSTSESTAALGCLVKDYFPEPVTVSWNSGALTSGVHTFPAVLQSSGLYSLSSVVTVP
SSNFGTQTYTCNVDHKPSNTKVDKTVERKCCVECPPCPAPPVAGPSVFLFPPKPKDTLMISRTP
EVTCVVVDVSHEDPEVQFNWYVDGVEVHNAKTKPREEQFNSTFRVVSVLTVVHQDWLNGKEYKC
KVSNKGLPAPIEKTISKTKGQPREPQVYTLPPSREEMTKNQVSLTCLVKGFYPSDIAVEWESNG
QPENNYKTTPPMLDSDGSFFLYSKLTVDKSRWQQGNVFSCSVMHEALHNHYTQKSLSLSPGK U<sub>B</sub>-2 heavy chain amino acid sequence (SEQ ID NO:49)
QVQLVQSGAEVKKPGASVKVSCKASGYTFTSYGISWVRQAPGQGLEWMGWISASNGNTNYAQKL
QDRVTMTTDTSTSTAYMELRSLRSDDTAVYYCAREDNWNYGFFDYWGQGTLVTVSSASTKGPSV
FPLAPCSRSTSESTAALGCLVKDYFPEPVTVSWNSGALTSGVHTFPAVLQSSGLYSLSSVVTVP
SSNFGTQTYTCNVDHKPSNTKVDKTVERKCCVECPPCPAPPVAGPSVFLFPPKPKDTLMISRTP
EVTCVVVDVSHEDPEVQFNWYVDGVEVHNAKTKPREEQFNSTFRVVSVLTVVHQDWLNGKEYKC
KVSNKGLPAPIEKTISKTKGQPREPQVYTLPPSREEMTKNQVSLTCLVKGFYPSDIAVEWESNG
QPENNYKTTPPMLDSDGSFFLYSKLTVDKSRWQQGNVFSCSVMHEALHNHYTQKSLSLSPGK U<sub>B</sub>-3 heavy chain amino acid sequence (SEQ ID NO:50)
QVHLVQSGAEVKKPGASVKVSCKVSGYTFTGHYMHWVRQAPGQGLEWMGWINPNSGGTNCAQKF
QGRVTMTRDTSISTAYMELSRLRSDDTAVYYCARSIAVALDYWGQGTLVTVSSASTKGPSVFPL
APCSRSTSESTAALGCLVKDYFPEPVTVSWNSGALTSGVHTFPAVLQSSGLYSLSSVVTVPSSN
FGTQTYTCNVDHKPSNTKVDKTVERKCCVECPPCPAPPVAGPSVFLFPPKPKDTLMISRTPEVT
CVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPE
NNYKTTPPMLDSDGSFFLYSKLTVDKSRWQQGNVFSCSVMHEALHNHYTQKSLSLSPGK U<sub>B</sub>-4 heavy chain amino acid sequence (SEQ ID NO:51)
QVQLVQSGAEVKKPGASVKVSCKASGYTFTGYYMHWVRQAPGQGLEWMGWINPNSGGTNHTQKF
QGRVTMTRDTSISTAYMELSRLRSDDTAVYYCARSIAVALDYWGQGTLVTVSSASTKGPSVFPL
APCSRSTSESTAALGCLVKDYFPEPVTVSWNSGALTSGVHTFPAVLQSSGLYSLSSVVTVPSSN
FGTQTYTCNVDHKPSNTKVDKTVERKCCVECPPCPAPPVAGPSVFLFPPKPKDTLMISRTPEVT
CVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPE
NNYKTTPPMLDSDGSFFLYSKLTVDKSRWQQGNVFSCSVMHEALHNHYTQKSLSLSPGK

FIGURE 4A

U<sub>H</sub>-5 heavy chain amino acid sequence (SEQ ID NO:52)
QVQLVQSGAEVRKPGASVKVSCKVSGYTLTELSMHWVRQAPGKGLEWMGSFDPEDGETIYAQKF
QGRVTMLEDTSTDTAYMELSSLRSEDTAVYYCATEGDGGYYYYGMDVWGQGTTVTVSSASTKGP
SVFPLAPCSRSTSESTAALGCLVKDYFPEPVTVSWNSGALTSGVHTFPAVLQSSGLYSLSSVVT
VPSSNFGTQTYTCNVDHKPSNTKVDKTVERKCCVECPPCPAPPVAGPSVFLFPPKPKDTLMISR
TPEVTCVVVDVSHEDPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLVKGFYPSDIAVEWES
NGQPENNYKTTPPMLDSDGSFFLYSKLTVDKSRWQQGNVFSCSVMHEALHNHYTQKSLSLSPGK U<sub>H</sub>-6 heavy chain amino acid sequence (SEQ ID NO:52)
QVQLVQSGAEVRKPGASVKVSCKVSGYTLTELSMHWVRQAPGKGLEWMGSFDPEDGETIYAQKF
QGRVTMLEDTSTDTAYMELSSLRSEDTAVYYCATEGDGGYYYYGMDVWGQGTTVTVSSASTKGP
SVFPLAPCSRSTSESTAALGCLVKDYFPEPVTVSWNSGALTSGVHTFPAVLQSSGLYSLSSVVT
VPSSNFGTQTYTCNVDHKPSNTKVDKTVERKCCVECPPCPAPPVAGPSVFLFPPKPKDTLMISR
TPEVTCVVVDVSHEDPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLVKGFYPSDIAVEWES
NGQPENNYKTTPPMLDSDGSFFLYSKLTVDKSRWQQGNVFSCSVMHEALHNHYTQKSLSLSPGK U<sub>H</sub>-7 heavy chain amino acid sequence (SEQ ID NO:53)
QVTLKESGPVLVKPTETLTLTCTVSGFSLSNARMGVSWIRQPPGKALEWLAHIFSNDEKSYSTS
LKSRLTISKDTSKSQVVLTMTNMDPVDTATYYCARMYSSGWYGVFDYWGQGTLVTVSSASTKGP
SVFPLAPCSRSTSESTAALGCLVKDYFPEPVTVSWNSGALTSGVHTFPAVLQSSGLYSLSSVVT
VPSSNFGTQTYTCNVDHKPSNTKVDKTVERKCCVECPPCPAPPVAGPSVFLFPPKPKDTLMISR
TPEVTCVVVDVSHEDPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLVKGFYPSDIAVEWES
NGQPENNYKTTPPMLDSDGSFFLYSKLTVDKSRWQQGNVFSCSVMHEALHNHYTQKSLSLSPGK U<sub>H</sub>-8 heavy chain amino acid sequence (SEQ ID NO:54)
QVTLKESGPVLVKPTETLTLTCTVSGFSLSNARMGVSWIRQPPGKALEWLVLIFSNDEKSYSTS
LKSRLTISKDTSKSQVVLTMTNMDPVDTATYYCARVYSSGWSFYGMDVWGQGTTVTVSSASTKG
PSVFPLAPCSRSTSESTAALGCLVKDYFPEPVTVSWNSGALTSGVHTFPAVLQSSGLYSLSSVV
TVPSSNFGTQTYTCNVDHKPSNTKVDKTVERKCCVECPPCPAPPVAGPSVFLFPPKPKDTLMIS
RTPEVTCVVVDVSHEDPEVQFNWYVDGVEVHNAKTKPREEQFNSTFRVVSVLTVVHQDWLNGKE
YKCKVSNKGLPAPIEKTISKTKGQPREPQVYTLPPSREEMTKNQVSLTCLVKGFYPSDIAVEWE
SNGQPENNYKTTPPMLDSDGSFFLYSKLTVDKSRWQQGNVFSCSVMHEALHNHYTQKSLSLSPGK

FIGURE 4B

U_H-9 heavy chain amino acid sequence (SEQ ID NO:55)
QITLKESGPTLVKPTQTLTLTCTFSGFSLSTGGVGVGWIRQPPGKALEWLALIYWNDDKRYSPS
LKSRLTITKDTSKNQVVLTMTNMDPVDTATYYCAHRRELPFDYWGQGTLVTVSSASTKGPSVFP
LAPCSRSTSESTAALGCLVKDYFPEPVTVSWNSGALTSGVHTFPAVLQSSGLYSLSSVVTVPSS
NFGTQTYTCNVDHKPSNTKVDKTVERKCCVECPPCPAPPVAGPSVFLFPPKPKDTLMISRTPEV
TCVVVDVSHEDPEVQFNWYVDGVEVHNAKTKPREEQFNSTFRVVSVLTVVHQDWLNGKEYKCKV
SNKGLPAPIEKTISKTKGQPREPQVYTLPPSREEMTKNQVSLTCLVKGFYPSDIAVEWESNGQP
ENNYKTTPPMLDSDGSFFLYSKLTVDKSRWQQGNVFSCSVMHEALHNHYTQKSLSLSPGK U_H-10 heavy chain amino acid sequence (SEQ ID NO:56)
QITLKESGPTLVKPTQTLTLTCTFSGFSLSTGGVGVGWIRQPPGKALEWLALIYWNDDKRYSPS
LKSRLTITKDTSKTQVVLTVTDMDPVDTATYYCAHRNWTPFDYWGQGTLVTVSSASTKGPSVFP
LAPCSRSTSESTAALGCLVKDYFPEPVTVSWNSGALTSGVHTFPAVLQSSGLYSLSSVVTVPSS
NFGTQTYTCNVDHKPSNTKVDKTVERKCCVECPPCPAPPVAGPSVFLFPPKPKDTLMISRTPEV
TCVVVDVSHEDPEVQFNWYVDGVEVHNAKTKPREEQFNSTFRVVSVLTVVHQDWLNGKEYKCKV
SNKGLPAPIEKTISKTKGQPREPQVYTLPPSREEMTKNQVSLTCLVKGFYPSDIAVEWESNGQP
ENNYKTTPPMLDSDGSFFLYSKLTVDKSRWQQGNVFSCSVMHEALHNHYTQKSLSLSPGK U_H-11 heavy chain amino acid sequence (SEQ ID NO:57)
QITLKESGPTLVKPTQTLTLTCTFSGFSLNTGGVGVGWIRQPPGKALEWLALIYWNDDKRYSPS
LKSRLTITKDTSKNQVVLTMTNMDPVDTATYYCAHRLELPFDYWGQGTLVTVSSASTKGPSVFP
LAPCSRSTSESTAALGCLVKDYFPEPVTVSWNSGALTSGVHTFPAVLQSSGLYSLSSVVTVPSS
NFGTQTYTCNVDHKPSNTKVDKTVERKCCVECPPCPAPPVAGPSVFLFPPKPKDTLMISRTPEV
TCVVVDVSHEDPEVQFNWYVDGVEVHNAKTKPREEQFNSTFRVVSVLTVVHQDWLNGKEYKCKV
SNKGLPAPIEKTISKTKGQPREPQVYTLPPSREEMTKNQVSLTCLVKGFYPSDIAVEWESNGQP
ENNYKTTPPMLDSDGSFFLYSKLTVDKSRWQQGNVFSCSVMHEALHNHYTQKSLSLSPGK U_H-12 heavy chain amino acid sequence (SEQ ID NO:58)
QITLKESGPTLVKPTQTLTLTCTFSGFSLSTGGVGVGWIRQPPGKALEWLALIYWNDDKRYSPS
LKSRLTITKDTSKNQVVLTMTNLDPVDTATYYCAHRREVPFDYWGQGTLVTVSSASTKGPSVFP
LAPCSRSTSESTAALGCLVKDYFPEPVTVSWNSGALTSGVHTFPAVLQSSGLYSLSSVVTVPSS
NFGTQTYTCNVDHKPSNTKVDKTVERKCCVECPPCPAPPVAGPSVFLFPPKPKDTLMISRTPEV
TCVVVDVSHEDPEVQFNWYVDGVEVHNAKTKPREEQFNSTFRVVSVLTVVHQDWLNGKEYKCKV
SNKGLPAPIEKTISKTKGQPREPQVYTLPPSREEMTKNQVSLTCLVKGFYPSDIAVEWESNGQP
ENNYKTTPPMLDSDGSFFLYSKLTVDKSRWQQGNVFSCSVMHEALHNHYTQKSLSLSPGK

FIGURE 4C

U<sub>H</sub>-13 heavy chain amino acid sequence (SEQ ID NO:59)
QITLKESGPTLVKPTQTLTLTCTFSGFSLSTGGVGVGWIRQPPGKALEWLALIYWNVEKRYSPS
LRSRLTITKATSKNQVVLTMTNMDPVDTATYYCAHRHTNPFEYWGQGTLVTVSSASTKGPSVFP
LAPCSRSTSESTAALGCLVKDYFPEPVTVSWNSGALTSGVHTFPAVLQSSGLYSLSSVVTVPSS
NFGTQTYTCNVDHKPSNTKVDKTVERKCCVECPPCPAPPVAGPSVFLFPPKPKDTLMISRTPEV
TCVVVDVSHEDPEVQFNWYVDGVEVHNAKTKPREEQFNSTFRVVSVLTVVHQDWLNGKEYKCKV
SNKGLPAPIEKTISKTKGQPREPQVYTLPPSREEMTKNQVSLTCLVKGFYPSDIAVEWESNGQP
ENNYKTTPPMLDSDGSFFLYSKLTVDKSRWQQGNVFSCSVMHEALHNHYTQKSLSLSPGK U<sub>H</sub>-14 heavy chain amino acid sequence (SEQ ID NO:60)
QITLKESGPTLVKPTQTLTLTCTFSGFSLSTGGVGVGWIRQPPGKALEWLALIYWNDDKRYSPS
LKSRLTITKDTSKNQVVLTMTNMDPVDTATYYCAHRGELPFDYWGQGTLVTVSSASTKGPSVFP
LAPCSRSTSESTAALGCLVKDYFPEPVTVSWNSGALTSGVHTFPAVLQSSGLYSLSSVVTVPSS
NFGTQTYTCNVDHKPSNTKVDKTVERKCCVECPPCPAPPVAGPSVFLFPPKPKDTLMISRTPEV
TCVVVDVSHEDPEVQFNWYVDGVEVHNAKTKPREEQFNSTFRVVSVLTVVHQDWLNGKEYKCKV
SNKGLPAPIEKTISKTKGQPREPQVYTLPPSREEMTKNQVSLTCLVKGFYPSDIAVEWESNGQP
ENNYKTTPPMLDSDGSFFLYSKLTVDKSRWQQGNVFSCSVMHEALHNHYTQKSLSLSPGK U<sub>H</sub>-15 heavy chain amino acid sequence (SEQ ID NO:60)
QITLKESGPTLVKPTQTLTLTCTFSGFSLSTGGVGVGWIRQPPGKALEWLALIYWNDDKRYSPS
LKSRLTITKDTSKNQVVLTMTNMDPVDTATYYCAHRGELPFDYWGQGTLVTVSSASTKGPSVFP
LAPCSRSTSESTAALGCLVKDYFPEPVTVSWNSGALTSGVHTFPAVLQSSGLYSLSSVVTVPSS
NFGTQTYTCNVDHKPSNTKVDKTVERKCCVECPPCPAPPVAGPSVFLFPPKPKDTLMISRTPEV
TCVVVDVSHEDPEVQFNWYVDGVEVHNAKTKPREEQFNSTFRVVSVLTVVHQDWLNGKEYKCKV
SNKGLPAPIEKTISKTKGQPREPQVYTLPPSREEMTKNQVSLTCLVKGFYPSDIAVEWESNGQP
ENNYKTTPPMLDSDGSFFLYSKLTVDKSRWQQGNVFSCSVMHEALHNHYTQKSLSLSPGK U<sub>H</sub>-16 heavy chain amino acid sequence (SEQ ID NO:61)
EVQLVESGGGLVKPGGSLRLSCAASGFPFSRYSMNWVRQAPGKGLEWVSAISSSSSYIYYADSV
KGRFTISRDNAKNSLYLQMNSLRAEDTAVYYCARDRVGATPDAFDIWGQGTMVTVSSASTKGPS
VFPLAPCSRSTSESTAALGCLVKDYFPEPVTVSWNSGALTSGVHTFPAVLQSSGLYSLSSVVTV
PSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYK
CKVSNKGLPAPIEKTISKTKGQPREPQVYTLPPSREEMTKNQVSLTCLVKGFYPSDIAVEWESN
GQPENNYKTTPPMLDSDGSFFLYSKLTVDKSRWQQGNVFSCSVMHEALHNHYTQKSLSLSPGK

FIGURE 4D

U_H-17 heavy chain amino acid sequence (SEQ ID NO:62)
EVQLLESGGGLVQPGGSLRLSCAASGFTFSSYAMNWVRQAPGKGLEWVSAISGSGGSTYYADSV
KGRFTISRDNSKNTLYLQMNSLRAEDTAVYYCAKEGIAVAGTAEYYYYYAMDVWGQGTTVTVSS
ASTKGPSVFPLAPCSRSTSESTAALGCLVKDYFPEPVTVSWNSGALTSGVHTFPAVLQSSGLYS
LSSVVTVPSSNFGTQTYTCNVDHKPSNTKVDKTVERKCCVECPPCPAPPVAGPSVFLFPPKPKD
TLMISRTPEVTCVVVDVSHEDPEVQFNWYVDGVEVHNAKTKPREEQFNSTFRVVSVLTVVHQDW
LNGKEYKCKVSNKGLPAPIEKTISKTKGQPREPQVYTLPPSREEMTKNQVSLTCLVKGFYPSDI
AVEWESNGQPENNYKTTPPMLDSDGSFFLYSKLTVDKSRWQQGNVFSCSVMHEALHNHYTQKSL
SLSPGK U_H-18 heavy chain amino acid sequence (SEQ ID NO:63)
EVQLLESGGGLVQPGGSLRLSCAASGFTFSSYAMSWVRQAPGKGLEWVSAISGSGGSTYYADSV
KGRFTISRDNSKNTLYLQMNSLRAEDTAVYYCAKEGIAARDSYYYYAMDVWGQGTTVTVSSASTK
GPSVFPLAPCSRSTSESTAALGCLVKDYFPEPVTVSWNSGALTSGVHTFPAVLQSSGLYSLSSV
VTVPSSNFGTQTYTCNVDHKPSNTKVDKTVERKCCVECPPCPAPPVAGPSVFLFPPKPKDTLMI
SRTPEVTCVVVDVSHEDPEVQFNWYVDGVEVHNAKTKPREEQFNSTFRVVSVLTVVHQDWLNGK
EYKCKVSNKGLPAPIEKTISKTKGQPREPQVYTLPPSREEMTKNQVSLTCLVKGFYPSDIAVEW
ESNGQPENNYKTTPPMLDSDGSFFLYSKLTVDKSRWQQGNVFSCSVMHEALHNHYTQKSLSLSP
GK U_H-19 heavy chain amino acid sequence (SEQ ID NO:64)
EVQLLESGGGLVQPGGSLRLSCTASGFTFSSYAMSWVRQAPGKGLEWVSAISGSGGSTYYADSV
KGRFTISRDNSKNTLYLQMNSLRAEDTAEYYCAKEGIAGRDSYYYYGMDVWGQGTTVTVSSASTK
GPSVFPLAPCSRSTSESTAALGCLVKDYFPEPVTVSWNSGALTSGVHTFPAVLQSSGLYSLSSV
VTVPSSNFGTQTYTCNVDHKPSNTKVDKTVERKCCVECPPCPAPPVAGPSVFLFPPKPKDTLMI
SRTPEVTCVVVDVSHEDPEVQFNWYVDGVEVHNAKTKPREEQFNSTFRVVSVLTVVHQDWLNGK
EYKCKVSNKGLPAPIEKTISKTKGQPREPQVYTLPPSREEMTKNQVSLTCLVKGFYPSDIAVEW
ESNGQPENNYKTTPPMLDSDGSFFLYSKLTVDKSRWQQGNVFSCSVMHEALHNHYTQKSLSLSP
GK U_H-20 heavy chain amino acid sequence (SEQ ID NO:64)
EVQLLESGGGLVQPGGSLRLSCTASGFTFSSYAMSWVRQAPGKGLEWVSAISGSGGSTYYADSV
KGRFTISRDNSKNTLYLQMNSLRAEDTAEYYCAKEGIAGRDSYYYYGMDVWGQGTTVTVSSASTK
GPSVFPLAPCSRSTSESTAALGCLVKDYFPEPVTVSWNSGALTSGVHTFPAVLQSSGLYSLSSV
VTVPSSNFGTQTYTCNVDHKPSNTKVDKTVERKCCVECPPCPAPPVAGPSVFLFPPKPKDTLMI
SRTPEVTCVVVDVSHEDPEVQFNWYVDGVEVHNAKTKPREEQFNSTFRVVSVLTVVHQDWLNGK
EYKCKVSNKGLPAPIEKTISKTKGQPREPQVYTLPPSREEMTKNQVSLTCLVKGFYPSDIAVEW
ESNGQPENNYKTTPPMLDSDGSFFLYSKLTVDKSRWQQGNVFSCSVMHEALHNHYTQKSLSLSP
GK

FIGURE 4E

U<sub>H</sub>-21 heavy chain amino acid sequence (SEQ ID NO:65)
QVQLVESGGGVVQPGRSLRLSCAASGFTFSSYGMHWVRQAPGKGLEWVAFISDDGSTKYYADSV
KGRFTISRDNSMNTLYLQMNSLRAEDTAVYYCARSYYDSSGYYYGFDYWGQGTLVTVSSASTKG
PSVFPLAPCSRSTSESTAALGCLVKDYFPEPVTVSWNSGALTSGVHTFPAVLQSSGLYSLSSVV
TVPSSNFGTQTYTCNVDHKPSNTKVDKTVERKCCVECPPCPAPPVAGPSVFLFPPKPKDTLMIS
RTPEVTCVVVDVSHEDPEVQFNWYVDGVEVHNAKTKPREEQFNSTFRVVSVLTVVHQDWLNGKE
YKCKVSNKGLPAPIEKTISKTKGQPREPQVYTLPPSREEMTKNQVSLTCLVKGFYPSDIAVEWE
SNGQPENNYKTTPPMLDSDGSFFLYSKLTVDKSRWQQGNVFSCSVMHEALHNHYTQKSLSLSPGK U<sub>H</sub>-22 heavy chain amino acid sequence (SEQ ID NO:65)
QVQLVESGGGVVQPGRSLRLSCAASGFTFSSYGMHWVRQAPGKGLEWVAFISDDGSTKYYADSV
KGRFTISRDNSMNTLYLQMNSLRAEDTAVYYCARSYYDSSGYYYGFDYWGQGTLVTVSSASTKG
PSVFPLAPCSRSTSESTAALGCLVKDYFPEPVTVSWNSGALTSGVHTFPAVLQSSGLYSLSSVV
TVPSSNFGTQTYTCNVDHKPSNTKVDKTVERKCCVECPPCPAPPVAGPSVFLFPPKPKDTLMIS
RTPEVTCVVVDVSHEDPEVQFNWYVDGVEVHNAKTKPREEQFNSTFRVVSVLTVVHQDWLNGKE
YKCKVSNKGLPAPIEKTISKTKGQPREPQVYTLPPSREEMTKNQVSLTCLVKGFYPSDIAVEWE
SNGQPENNYKTTPPMLDSDGSFFLYSKLTVDKSRWQQGNVFSCSVMHEALHNHYTQKSLSLSPGK U<sub>H</sub>-23 heavy chain amino acid sequence (SEQ ID NO:66)
QVQLVESGGGVVQPGRSLRLSCAASGFTFSSYGMHWVRQAPGKGLEWVAVIWYDGSNKYYADSV
KGRFTISRDNSKNTLYLQMNSLRAEDTAVYYCARNVIDYWGQGTLVTVSSASTKGPSVFPLAPC
SRSTSESTAALGCLVKDYFPEPVTVSWNSGALTSGVHTFPAVLQSSGLYSLSSVVTVPSSNFGT
QTYTCNVDHKPSNTKVDKTVERKCCVECPPCPAPPVAGPSVFLFPPKPKDTLMISRTPEVTCVV
VDVSHEDPEVQFNWYVDGVEVHNAKTKPREEQFNSTFRVVSVLTVVHQDWLNGKEYKCKVSNKG
LPAPIEKTISKTKGQPREPQVYTLPPSREEMTKNQVSLTCLVKGFYPSDIAVEWESNGQPENNY
KTTPPMLDSDGSFFLYSKLTVDKSRWQQGNVFSCSVMHEALHNHYTQKSLSLSPGK U<sub>H</sub>-24 heavy chain amino acid sequence (SEQ ID NO:67)
QVQLVESGGGVVQPGRSLRLSCAASGFTFSSYDMHWVRQAPGKGLEWVAVIWYDGSIKYYADSV
KGRFTISRDNSKNTLYLQMNSLRAEDTAVYYCARGGATGAEYFQHWGQGTLVTVSSASTKGPSV
FPLAPCSRSTSESTAALGCLVKDYFPEPVTVSWNSGALTSGVHTFPAVLQSSGLYSLSSVVTVP
SSNFGTQTYTCNVDHKPSNTKVDKTVERKCCVECPPCPAPPVAGPSVFLFPPKPKDTLMISRTP
EVTCVVVDVSHEDPEVQFNWYVDGVEVHNAKTKPREEQFNSTFRVVSVLTVVHQDWLNGKEYKC
KVSNKGLPAPIEKTISKTKGQPREPQVYTLPPSREEMTKNQVSLTCLVKGFYPSDIAVEWESNG
QPENNYKTTPPMLDSDGSFFLYSKLTVDKSRWQQGNVFSCSVMHEALHNHYTQKSLSLSPGK

FIGURE 4F

U<sub>H</sub>-25 heavy chain amino acid sequence (SEQ ID NO:67)
QVQLVESGGGVVQPGRSLRLSCAASGFTFSSYDMHWVRQAPGKGLEWVAVIWYDGSIKYYADSV
KGRFTISRDNSKNTLYLQMNSLRAEDTAVYYCARGGATGAEYFQHWGQGTLVTVSSASTKGPSV
FPLAPCSRSTSESTAALGCLVKDYFPEPVTVSWNSGALTSGVHTFPAVLQSSGLYSLSSVVTVP
SSNFGTQTYTCNVDHKPSNTKVDKTVERKCCVECPPCPAPPVAGPSVFLFPPKPKDTLMISRTP
EVTCVVVDVSHEDPEVQFNWYVDGVEVHNAKTKPREEQFNSTFRVVSVLTVVHQDWLNGKEYKC
KVSNKGLPAPIEKTISKTKGQPREPQVYTLPPSREEMTKNQVSLTCLVKGFYPSDIAVEWESNG
QPENNYKTTPPMLDSDGSFFLYSKLTVDKSRWQQGNVFSCSVMHEALHNHYTQKSLSLSPGK

U<sub>H</sub>-26 heavy chain amino acid sequence (SEQ ID NO:68)
QVQLVESGGGVVQPGRSLRLSCAASGFTFSSYGMHWVRQAPGKGLEWVAVIWYDGSNKYYADSV
KGRFTISRDNSKNTLYLQMNSLRAEDTAVYYCVLLWFGETFDYWGQGSLVTVSPASTKGPSVFP
LAPCSRSTSESTAALGCLVKDYFPEPVTVSWNSGALTSGVHTFPAVLQSSGLYSLSSVVTVPSS
NFGTQTYTCNVDHKPSNTKVDKTVERKCCVECPPCPAPPVAGPSVFLFPPKPKDTLMISRTPEV
TCVVVDVSHEDPEVQFNWYVDGVEVHNAKTKPREEQFNSTFRVVSVLTVVHQDWLNGKEYKCKV
SNKGLPAPIEKTISKTKGQPREPQVYTLPPSREEMTKNQVSLTCLVKGFYPSDIAVEWESNGQP
ENNYKTTPPMLDSDGSFFLYSKLTVDKSRWQQGNVFSCSVMHEALHNHYTQKSLSLSPGK

U<sub>H</sub>-27 heavy chain amino acid sequence (SEQ ID NO:69)
QVQLVESGGGVVQPGRSLRLSCAASGFTFSSYGMHWVRQAPGKGLEWVAVIWSDGSNKYYADSV
KGRFTISRDNSKNTLYLQMNSLRAEDTAVYYCARNLPFDYWGQGTLVTVSSASTKGPSVFPLAP
CSRSTSESTAALGCLVKDYFPEPVTVSWNSGALTSGVHTFPAVLQSSGLYSLSSVVTVPSSNFG
TQTYTCNVDHKPSNTKVDKTVERKCCVECPPCPAPPVAGPSVFLFPPKPKDTLMISRTPEVTCV
VVDVSHEDPEVQFNWYVDGVEVHNAKTKPREEQFNSTFRVVSVLTVVHQDWLNGKEYKCKVSNK
GLPAPIEKTISKTKGQPREPQVYTLPPSREEMTKNQVSLTCLVKGFYPSDIAVEWESNGQPENN
YKTTPPMLDSDGSFFLYSKLTVDKSRWQQGNVFSCSVMHEALHNHYTQKSLSLSPGK

U<sub>H</sub>-28 heavy chain amino acid sequence (SEQ ID NO:70)
QVQLVESGGGVVQPGRSLRLSCAASGFTFSSYGMHWVRQAPGKGLEWVAVIWDDGSNQYYTDSV
KGRFTVSRDNSKNTLFLQMNSLRAEDTAVYYCARSHYGGDYDYYGMDVWGQGTTVTVSSASTKG
PSVFPLAPCSRSTSESTAALGCLVKDYFPEPVTVSWNSGALTSGVHTFPAVLQSSGLYSLSSVV
TVPSSNFGTQTYTCNVDHKPSNTKVDKTVERKCCVECPPCPAPPVAGPSVFLFPPKPKDTLMIS
RTPEVTCVVVDVSHEDPEVQFNWYVDGVEVHNAKTKPREEQFNSTFRVVSVLTVVHQDWLNGKE
YKCKVSNKGLPAPIEKTISKTKGQPREPQVYTLPPSREEMTKNQVSLTCLVKGFYPSDIAVEWE
SNGQPENNYKTTPPMLDSDGSFFLYSKLTVDKSRWQQGNVFSCSVMHEALHNHYTQKSLSLSPGK

FIGURE 4G

U<sub>H</sub>-29 heavy chain amino acid sequence (SEQ ID NO:71)
QVQLVESGGGVVQPGRSLRLSCAASGFTFSSYGMHWVRQAPGKGLEWVAVIWYDGSNKRYVDSV
KGRFTISRDNSKNTLYLQMNSLRAEDTAVYYCARDGWQQQAPFDYWGQGTLVTVSSASTKGPSV
FPLAPCSRSTSESTAALGCLVKDYFPEPVTVSWNSGALTSGVHTFPAVLQSSGLYSLSSVVTVP
SSNFGTQTYTCNVDHKPSNTKVDKTVERKCCVECPPCPAPPVAGPSVFLFPPKPKDTLMISRTP
EVTCVVVDVSHEDPEVQFNWYVDGVEVHNAKTKPREEQFNSTFRVVSVLTVVHQDWLNGKEYKC
KVSNKGLPAPIEKTISKTKGQPREPQVYTLPPSREEMTKNQVSLTCLVKGFYPSDIAVEWESNG
QPENNYKTTPPMLDSDGSFFLYSKLTVDKSRWQQGNVFSCSVMHEALHNHYTQKSLSLSPGK

U<sub>H</sub>-30 heavy chain amino acid sequence (SEQ ID NO:72)
QVQLVESGGGVVQPGRSLRLSCAASGFTFRSHGMHWVRQAPGKGLEWVAVIWYDGSNKNYADSV
RGRFTISRDNSKNTLDLQMNSLRAEDTAVYYCARWGISAPFDCWGQGTLVTVSSASTKGPSVFP
LAPCSRSTSESTAALGCLVKDYFPEPVTVSWNSGALTSGVHTFPAVLQSSGLYSLSSVVTVPSS
NFGTQTYTCNVDHKPSNTKVDKTVERKCCVECPPCPAPPVAGPSVFLFPPKPKDTLMISRTPEV
TCVVVDVSHEDPEVQFNWYVDGVEVHNAKTKPREEQFNSTFRVVSVLTVVHQDWLNGKEYKCKV
SNKGLPAPIEKTISKTKGQPREPQVYTLPPSREEMTKNQVSLTCLVKGFYPSDIAVEWESNGQP
ENNYKTTPPMLDSDGSFFLYSKLTVDKSRWQQGNVFSCSVMHEALHNHYTQKSLSLSPGK

U<sub>H</sub>-31 heavy chain amino acid sequence (SEQ ID NO:73)
EVQLVESGGGLVQPGGSLRLSCAASGFTFSAYSMNWVRQAPGKGLEWVSYISSSGRTIYYADSV
KGRFTISRDNAKNSLFLQMNSLRDEDTAVYYCALWAPFDYWGQGTLVTVSSASTKGPSVFPLAP
CSRSTSESTAALGCLVKDYFPEPVTVSWNSGALTSGVHTFPAVLQSSGLYSLSSVVTVPSSNFG
TQTYTCNVDHKPSNTKVDKTVERKCCVECPPCPAPPVAGPSVFLFPPKPKDTLMISRTPEVTCV
VVDVSHEDPEVQFNWYVDGVEVHNAKTKPREEQFNSTFRVVSVLTVVHQDWLNGKEYKCKVSNK
GLPAPIEKTISKTKGQPREPQVYTLPPSREEMTKNQVSLTCLVKGFYPSDIAVEWESNGQPENN
YKTTPPMLDSDGSFFLYSKLTVDKSRWQQGNVFSCSVMHEALHNHYTQKSLSLSPGK

U<sub>H</sub>-32 heavy chain amino acid sequence (SEQ ID NO:74)
EVQLVESGGGLVQPGGSLRLSCAASGFTFSSYSMNWVRQAPGKGLEWVSHISSSSRTIYYADSV
KGRFTISRDNAKNSVYLQMNSLRDEDTAVYYCARDGYNWNGGGNYYGMDVWGQGTTVTVSSASTK
GPSVFPLAPCSRSTSESTAALGCLVKDYFPEPVTVSWNSGALTSGVHTFPAVLQSSGLYSLSSV
VTVPSSNFGTQTYTCNVDHKPSNTKVDKTVERKCCVECPPCPAPPVAGPSVFLFPPKPKDTLMI
SRTPEVTCVVVDVSHEDPEVQFNWYVDGVEVHNAKTKPREEQFNSTFRVVSVLTVVHQDWLNGK
EYKCKVSNKGLPAPIEKTISKTKGQPREPQVYTLPPSREEMTKNQVSLTCLVKGFYPSDIAVEW
ESNGQPENNYKTTPPMLDSDGSFFLYSKLTVDKSRWQQGNVFSCSVMHEALHNHYTQKSLSLSP
GK

FIGURE 4H

U_H-33 heavy chain amino acid sequence (SEQ ID NO:75)
EVQLVESGGGLVQPGGSLRLSCAASGFTFSSYSMNWVRQAPGKGLEWVSHISRSSRTIYYADSV
KGRFTISRDNAKNSLYLQMNSLRDEDTAVYYCARDGYNWNNGGYYYGMDVWGQGTTVTVSSASTK
GPSVFPLAPCSRSTSESTAALGCLVKDYFPEPVTVSWNSGALTSGVHTFPAVLQSSGLYSLSSV
VTVPSSNFGTQTYTCNVDHKPSNTKVDKTVERKCCVECPPCPAPPVAGPSVFLFPPKPKDTLMI
SRTPEVTCVVVDVSHEDPEVQFNWYVDGVEVHNAKTKPREEQFNSTFRVVSVLTVVHQDWLNGK
EYKCKVSNKGLPAPIEKTISKTKGQPREPQVYTLPPSREEMTKNQVSLTCLVKGFYPSDIAVEW
ESNGQPENNYKTTPPMLDSDGSFFLYSKLTVDKSRWQQGNVFSCSVMHEALHNHYTQKSLSLSP
GK U_H-34 heavy chain amino acid sequence (SEQ ID NO:75)
EVQLVESGGGLVQPGGSLRLSCAASGFTFSSYSMNWVRQAPGKGLEWVSHISRSSRTIYYADSV
KGRFTISRDNAKNSLYLQMNSLRDEDTAVYYCARDGYNWNNGGYYYGMDVWGQGTTVTVSSASTK
GPSVFPLAPCSRSTSESTAALGCLVKDYFPEPVTVSWNSGALTSGVHTFPAVLQSSGLYSLSSV
VTVPSSNFGTQTYTCNVDHKPSNTKVDKTVERKCCVECPPCPAPPVAGPSVFLFPPKPKDTLMI
SRTPEVTCVVVDVSHEDPEVQFNWYVDGVEVHNAKTKPREEQFNSTFRVVSVLTVVHQDWLNGK
EYKCKVSNKGLPAPIEKTISKTKGQPREPQVYTLPPSREEMTKNQVSLTCLVKGFYPSDIAVEW
ESNGQPENNYKTTPPMLDSDGSFFLYSKLTVDKSRWQQGNVFSCSVMHEALHNHYTQKSLSLSP
GK U_H-35 heavy chain amino acid sequence (SEQ ID NO:76)
QVQLQESGPGLVKPSQTLSLTCTVSGGSVSSGGYYWSWIRQHPGKGLEWIGYIHSSGSTYYNPS
LKSRVTISVDTSKNQFSLNLSSVTAADTAVYYCARGPYYGMDVWGQGTTVTVSSASTKGPSVFP
LAPCSRSTSESTAALGCLVKDYFPEPVTVSWNSGALTSGVHTFPAVLQSSGLYSLSSVVTVPSS
NFGTQTYTCNVDHKPSNTKVDKTVERKCCVECPPCPAPPVAGPSVFLFPPKPKDTLMISRTPEV
TCVVVDVSHEDPEVQFNWYVDGVEVHNAKTKPREEQFNSTFRVVSVLTVVHQDWLNGKEYKCKV
SNKGLPAPIEKTISKTKGQPREPQVYTLPPSREEMTKNQVSLTCLVKGFYPSDIAVEWESNGQP
ENNYKTTPPMLDSDGSFFLYSKLTVDKSRWQQGNVFSCSVMHEALHNHYTQKSLSLSPGK U_H-36 heavy chain amino acid sequence (SEQ ID NO:77)
QVQLQESGPGLVKPSQTLSLTCTVSGGSISRGGYYWSWIRQHPGKGLEWIGYIYHSGSTYYNPS
LKSRVNMSVDTSKNQFSLKLSSVTAADTAVYYCARALRGIVLMVYVLGALDIWGQGTKVTVSSA
STKGPSVFPLAPCSRSTSESTAALGCLVKDYFPEPVTVSWNSGALTSGVHTFPAVLQSSGLYSL
SSVVTVPSSNFGTQTYTCNVDHKPSNTKVDKTVERKCCVECPPCPAPPVAGPSVFLFPPKPKDT
LMISRTPEVTCVVVDVSHEDPEVQFNWYVDGVEVHNAKTKPREEQFNSTFRVVSVLTVVHQDWL
NGKEYKCKVSNKGLPAPIEKTISKTKGQPREPQVYTLPPSREEMTKNQVSLTCLVKGFYPSDIA
VEWESNGQPENNYKTTPPMLDSDGSFFLYSKLTVDKSRWQQGNVFSCSVMHEALHNHYTQKSLS
LSPGK

FIGURE 4I

U_H-37 heavy chain amino acid sequence (SEQ ID NO:77)
QVQLQESGPGLVKPSQTLSLTCTVSGGSISRGGYYWSWIRQHPGKGLEWIGYIYHSGSTYYNPS
LKSRVNMSVDTSKNQFSLKLSSVTAADTAVYYCARALRGIVLMVYVLGALDIWGQGTKVTVSSA
STKGPSVFPLAPCSRSTSESTAALGCLVKDYFPEPVTVSWNSGALTSGVHTFPAVLQSSGLYSL
SSVVTVPSSNFGTQTYTCNVDHKPSNTKVDKTVERKCCVECPPCPAPPVAGPSVFLFPPKPKDT
LMISRTPEVTCVVVDVSHEDPEVQFNWYVDGVEVHNAKTKPREEQFNSTFRVVSVLTVVHQDWL
NGKEYKCKVSNKGLPAPIEKTISKTKGQPREPQVYTLPPSREEMTKNQVSLTCLVKGFYPSDIA
VEWESNGQPENNYKTTPPMLDSDGSFFLYSKLTVDKSRWQQGNVFSCSVMHEALHNHYTQKSLS
LSPGK U_H-38 heavy chain amino acid sequence (SEQ ID NO:78)
QVQLQESGPGLVKPSQTLSLTCTVSGGSISSGGYYWSWIRQHPGKGLEWIGYIYYSGSTYYNPS
LKSRVTISVDTSKNQFSLKLSSVTAADTAVYYCARDETVVRGLIRYCYGMDVWGQGTTVTVSSA
STKGPSVFPLAPCSRSTSESTAALGCLVKDYFPEPVTVSWNSGALTSGVHTFPAVLQSSGLYSL
SSVVTVPSSNFGTQTYTCNVDHKPSNTKVDKTVERKCCVECPPCPAPPVAGPSVFLFPPKPKDT
LMISRTPEVTCVVVDVSHEDPEVQFNWYVDGVEVHNAKTKPREEQFNSTFRVVSVLTVVHQDWL
NGKEYKCKVSNKGLPAPIEKTISKTKGQPREPQVYTLPPSREEMTKNQVSLTCLVKGFYPSDIA
VEWESNGQPENNYKTTPPMLDSDGSFFLYSKLTVDKSRWQQGNVFSCSVMHEALHNHYTQKSLS
LSPGK U_H-39 heavy chain amino acid sequence (SEQ ID NO:79)
QVQLQESGPGLVKPSQTLSLNCTVSGGSISSGGYYWSWIRQHPGKGLEWIGYIHYSGSTYYNPS
LKSRITISADTSKNQFSLKLNSVTAADTAVYYCARDRGGGDYGRMDVWGQGTTVTVSSASTKGP
SVFPLAPCSRSTSESTAALGCLVKDYFPEPVTVSWNSGALTSGVHTFPAVLQSSGLYSLSSVVT
VPSSNFGTQTYTCNVDHKPSNTKVDKTVERKCCVECPPCPAPPVAGPSVFLFPPKPKDTLMISR
TPEVTCVVVDVSHEDPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLVKGFYPSDIAVEWES
NGQPENNYKTTPPMLDSDGSFFLYSKLTVDKSRWQQGNVFSCSVMHEALHNHYTQKSLSLSPGK U_H-40 heavy chain amino acid sequence (SEQ ID NO:80)
QVQLQESGPGLVKPSQTLSLNCTVSGGSISSGGYYWSWIRQHPGKGLEWIGYIHYSGSTYYNPS
LKSRITISADTSKNQFSLKLNSVTAADTAVYYCARDRGGGDYGRMDVWGQGTTVTVSSASTKGP
SVFPLAPCSRSTSESTAALGCLVKDYFPEPVTVSWNSGALTSGVHTFPAVLQSSGLYSLSSVVT
VPSSNFGTQTYTCNVDHKPSNTKVDKTVERKCCVECPPCPAPPVAGPSVFLFPPKPKDTLMISR
TPEVTCVVVDVSHEDPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLVKGFYPSDIAVEWES
NGQPENNYKTTPPMLDSDGSFFLYSKLTVDKSRWQQGNVFSCSVMHEALHNHYTQKSLSLSPGK

FIGURE 4J

U$_H$-41 heavy chain amino acid sequence (SEQ ID NO:81)
QVQLQESGPGLVKPSQTLSLTCTVSGGSISSGGYYWSWI81RQHPGKGLEWIGYIHSSGSTYYN
PSLKSRITKSVDTSKNQFSLKLSSVTAADTAVYYCARSNNYGCFALWGRGTLVTVSSASTKGPS
VFPLAPCSRSTSESTAALGCLVKDYFPEPVTVSWNSGALTSGVHTFPAVLQSSGLYSLSSVVTV
PSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYK
CKVSNKGLPAPIEKTISKTKGQPREPQVYTLPPSREEMTKNQVSLTCLVKGFYPSDIAVEWESN
GQPENNYKTTPPMLDSDGSFFLYSKLTVDKSRWQQGNVFSCSVMHEALHNHYTQKSLSLSPGK U$_H$-42 heavy chain amino acid sequence (SEQ ID NO:82)
QVQLQESGPGLVKPSQTLSLTCTVSGGSISSGGYYWSWIRQHPGKGLEWIGYIHSSGSTYYNPS
LKSRITKSVDTSKNQFSLKLSSVTAADTAVYYCARSNNYGCFALWGRGTLVTVSSASTKGPSVF
PLAPCSRSTSESTAALGCLVKDYFPEPVTVSWNSGALTSGVHTFPAVLQSSGLYSLSSVVTVPS
SNFGTQTYTCNVDHKPSNTKVDKTVERKCCVECPPCPAPPVAGPSVFLFPPKPKDTLMISRTPE
VTCVVVDVSHEDPEVQFNWYVDGVEVHNAKTKPREEQFNSTFRVVSVLTVVHQDWLNGKEYKCK
VSNKGLPAPIEKTISKTKGQPREPQVYTLPPSREEMTKNQVSLTCLVKGFYPSDIAVEWESNGQ
PENNYKTTPPMLDSDGSFFLYSKLTVDKSRWQQGNVFSCSVMHEALHNHYTQKSLSLSPGK U$_H$-43 heavy chain amino acid sequence (SEQ ID NO:83)
QVQLQESGPGLVKPSQTLSLTCTVSGGSISSGGYYWSWIRQHPGKGLEWIGYIHYSGSTYYNPS
LKSRVTISVDTSKNQFSLKLSSVTAADTAVYYCASGYNYGLYYYDSSGYPSYYYGMDVWGQGTT
VTVSSASTKGPSVFPLAPCSRSTSESTAALGCLVKDYFPEPVTVSWNSGALTSGVHTFPAVLQS
SGLYSLSSVVTVPSSNFGTQTYTCNVDHKPSNTKVDKTVERKCCVECPPCPAPPVAGPSVFLFP
PKPKDTLMISRTPEVTCVVVDVSHEDPEVQFNWYVDGVEVHNAKTKPREEQFNSTFRVVSVLTV
VHQDWLNGKEYKCKVSNKGLPAPIEKTISKTKGQPREPQVYTLPPSREEMTKNQVSLTCLVKGF
YPSDIAVEWESNGQPENNYKTTPPMLDSDGSFFLYSKLTVDKSRWQQGNVFSCSVMHEALHNHY
TQKSLSLSPGK U$_H$-44 heavy chain amino acid sequence (SEQ ID NO:84)
QVQLQESGPGLVKPSQTLSLTCTVSGGSISSGDYYWNWVRQHPGKGLEWIGYIYYSGGTYYNPS
LKSRVTISVDTSKNQFSLKLFSVTAADTAVYFCARTYYDILTGYPFYFDYWGQGTLVTVSSASTK
GPSVFPLAPCSRSTSESTAALGCLVKDYFPEPVTVSWNSGALTSGVHTFPAVLQSSGLYSLSSV
VTVPSSNFGTQTYTCNVDHKPSNTKVDKTVERKCCVECPPCPAPPVAGPSVFLFPPKPKDTLMI
SRTPEVTCVVVDVSHEDPEVQFNWYVDGVEVHNAKTKPREEQFNSTFRVVSVLTVVHQDWLNGK
EYKCKVSNKGLPAPIEKTISKTKGQPREPQVYTLPPSREEMTKNQVSLTCLVKGFYPSDIAVEW
ESNGQPENNYKTTPPMLDSDGSFFLYSKLTVDKSRWQQGNVFSCSVMHEALHNHYTQKSLSLSP
GK

FIGURE 4K

U<sub>H</sub>-45 heavy chain amino acid sequence (SEQ ID NO:85)
QVQLQESGPGLVKPSQTLSLTCTVSGGSISSGDYYWNWVRQHPGKGLEWIGYIYYSGGTYYNPS
LKSRVTISVDTSKNQFSLKLFSVTAADTAVYFCARTYYDILTGYPFYFDYWGQGTLVTVSSASTK
GPSVFPLAPCSRSTSESTAALGCLVKDYFPEPVTVSWNSGALTSGVHTFPAVLQSSGLYSLSSV
VTVPSSNFGTQTYTCNVDHKPSNTKVDKTVERKCCVECPPCPAPPVAGPSVFLFPPKPKDTLMI
SRTPEVTCVVVDVSHEDPEVQFNWYVDGVEVHNAKTKPREEQFNSTFRVVSVLTVVHQDWLNGK
EYKCKVSNKGLPAPIEKTISKTKGQPREPQVYTLPPSREEMTKNQVSLTCLVKGFYPSDIAVEW
ESNGQPENNYKTTPPMLDSDGSFFLYSKLTVDKSRWQQGNVFSCSVMHEALHNHYTQKSLSLSP
GK

U<sub>H</sub>-46 heavy chain amino acid sequence (SEQ ID NO:86)
QVQLQQWGAGLLKPSETLSLTCAVYGGSFSGYYWSWIRQPPGKGLEWIGEINHSGSTNYNPSLK
SRVTISVDTSKNQFSLKLSSVTAADTAVYYCARGGYSSSWYWFDPWGQGTLVTVSSASTKGPSV
FPLAPCSRSTSESTAALGCLVKDYFPEPVTVSWNSGALTSGVHTFPAVLQSSGLYSLSSVVTVP
SSNFGTQTYTCNVDHKPSNTKVDKTVERKCCVECPPCPAPPVAGPSVFLFPPKPKDTLMISRTP
EVTCVVVDVSHEDPEVQFNWYVDGVEVHNAKTKPREEQFNSTFRVVSVLTVVHQDWLNGKEYKC
KVSNKGLPAPIEKTISKTKGQPREPQVYTLPPSREEMTKNQVSLTCLVKGFYPSDIAVEWESNG
QPENNYKTTPPMLDSDGSFFLYSKLTVDKSRWQQGNVFSCSVMHEALHNHYTQKSLSLSPGK

U<sub>H</sub>-47 heavy chain amino acid sequence (SEQ ID NO:87)
QVQLQQWGAGLLKPSETLSLTCAVYGGSFSGYYWSWIRQPPGKGLEWIGEINHSGSTNYNPSLK
SRVTISVDTSKNQFSLKLSSVTAADTAVYYCARGGYSSSWFWFDPWGQGTLVTVSSASTKGPSV
FPLAPCSRSTSESTAALGCLVKDYFPEPVTVSWNSGALTSGVHTFPAVLQSSGLYSLSSVVTVP
SSNFGTQTYTCNVDHKPSNTKVDKTVERKCCVECPPCPAPPVAGPSVFLFPPKPKDTLMISRTP
EVTCVVVDVSHEDPEVQFNWYVDGVEVHNAKTKPREEQFNSTFRVVSVLTVVHQDWLNGKEYKC
KVSNKGLPAPIEKTISKTKGQPREPQVYTLPPSREEMTKNQVSLTCLVKGFYPSDIAVEWESNG
QPENNYKTTPPMLDSDGSFFLYSKLTVDKSRWQQGNVFSCSVMHEALHNHYTQKSLSLSPGK

U<sub>H</sub>-48 heavy chain amino acid sequence (SEQ ID NO:87)
QVQLQQWGAGLLKPSETLSLTCAVYGGSFSGYYWSWIRQPPGKGLEWIGEINHSGSTNYNPSLK
SRVTISVDTSKNQFSLKLSSVTAADTAVYYCARGGYSSSWFWFDPWGQGTLVTVSSASTKGPSV
FPLAPCSRSTSESTAALGCLVKDYFPEPVTVSWNSGALTSGVHTFPAVLQSSGLYSLSSVVTVP
SSNFGTQTYTCNVDHKPSNTKVDKTVERKCCVECPPCPAPPVAGPSVFLFPPKPKDTLMISRTP
EVTCVVVDVSHEDPEVQFNWYVDGVEVHNAKTKPREEQFNSTFRVVSVLTVVHQDWLNGKEYKC
KVSNKGLPAPIEKTISKTKGQPREPQVYTLPPSREEMTKNQVSLTCLVKGFYPSDIAVEWESNG
QPENNYKTTPPMLDSDGSFFLYSKLTVDKSRWQQGNVFSCSVMHEALHNHYTQKSLSLSPGK

FIGURE 4L

U$_H$-49 heavy chain amino acid sequence (SEQ ID NO:87)
QVQLQQWGAGLLKPSETLSLTCAVYGGSFSGYYWSWIRQPPGKGLEWIGEINHSGSTNYNPSLK
SRVTISVDTSKNQFSLKLSSVTAADTAVYYCARGGYSSSWFWFDPWGQGTLVTVSSASTKGPSV
FPLAPCSRSTSESTAALGCLVKDYFPEPVTVSWNSGALTSGVHTFPAVLQSSGLYSLSSVVTVP
SSNFGTQTYTCNVDHKPSNTKVDKTVERKCCVECPPCPAPPVAGPSVFLFPPKPKDTLMISRTP
EVTCVVVDVSHEDPEVQFNWYVDGVEVHNAKTKPREEQFNSTFRVVSVLTVVHQDWLNGKEYKC
KVSNKGLPAPIEKTISKTKGQPREPQVYTLPPSREEMTKNQVSLTCLVKGFYPSDIAVEWESNG
QPENNYKTTPPMLDSDGSFFLYSKLTVDKSRWQQGNVFSCSVMHEALHNHYTQKSLSLSPGK U$_H$-50 heavy chain amino acid sequence (SEQ ID NO:87)
QVQLQQWGAGLLKPSETLSLTCAVYGGSFSGYYWSWIRQPPGKGLEWIGEINHSGSTNYNPSLK
SRVTISVDTSKNQFSLKLSSVTAADTAVYYCARGGYSSSWFWFDPWGQGTLVTVSSASTKGPSV
FPLAPCSRSTSESTAALGCLVKDYFPEPVTVSWNSGALTSGVHTFPAVLQSSGLYSLSSVVTVP
SSNFGTQTYTCNVDHKPSNTKVDKTVERKCCVECPPCPAPPVAGPSVFLFPPKPKDTLMISRTP
EVTCVVVDVSHEDPEVQFNWYVDGVEVHNAKTKPREEQFNSTFRVVSVLTVVHQDWLNGKEYKC
KVSNKGLPAPIEKTISKTKGQPREPQVYTLPPSREEMTKNQVSLTCLVKGFYPSDIAVEWESNG
QPENNYKTTPPMLDSDGSFFLYSKLTVDKSRWQQGNVFSCSVMHEALHNHYTQKSLSLSPGK U$_H$-51 heavy chain amino acid sequence (SEQ ID NO:88)
QVQLQESGPGLVKPSETLSLTCTVSGGSISSYYWSWIRQPAGKGLEWIGRIYTSGTTNYNPSLK
SRVTMSVDTSKNQFSLKLSSVTAADTAVYYCARDGYSYGHYYYYGMDVWGQGTTVTVSSASTKG
PSVFPLAPCSRSTSESTAALGCLVKDYFPEPVTVSWNSGALTSGVHTFPAVLQSSGLYSLSSVV
TVPSSNFGTQTYTCNVDHKPSNTKVDKTVERKCCVECPPCPAPPVAGPSVFLFPPKPKDTLMIS
RTPEVTCVVVDVSHEDPEVQFNWYVDGVEVHNAKTKPREEQFNSTFRVVSVLTVVHQDWLNGKE
YKCKVSNKGLPAPIEKTISKTKGQPREPQVYTLPPSREEMTKNQVSLTCLVKGFYPSDIAVEWE
SNGQPENNYKTTPPMLDSDGSFFLYSKLTVDKSRWQQGNVFSCSVMHEALHNHYTQKSLSLSPGK U$_H$-52 heavy chain amino acid sequence (SEQ ID NO:89)
QVQLQESGPGLVKPSETLSLTCTVSGGSVSSGGSYWSWIRQPPGKGLEWIGYIYYSGSTNYNPS
LKSRVTISIVTSRNQFSLKLSSVTAADTAVYYCARSALRYFDWLFSDVSDIWGQGTMVTVSSAS
TKGPSVFPLAPCSRSTSESTAALGCLVKDYFPEPVTVSWNSGALTSGVHTFPAVLQSSGLYSLS
SVVTVPSSNFGTQTYTCNVDHKPSNTKVDKTVERKCCVECPPCPAPPVAGPSVFLFPPKPKDTL
MISRTPEVTCVVVDVSHEDPEVQFNWYVDGVEVHNAKTKPREEQFNSTFRVVSVLTVVHQDWLN
GKEYKCKVSNKGLPAPIEKTISKTKGQPREPQVYTLPPSREEMTKNQVSLTCLVKGFYPSDIAV
EWESNGQPENNYKTTPPMLDSDGSFFLYSKLTVDKSRWQQGNVFSCSVMHEALHNHYTQKSLSL
SPGK

FIGURE 4M

U$_H$-53 heavy chain amino acid sequence (SEQ ID NO:89)
QVQLQESGPGLVKPSETLSLTCTVSGGSVSSGGSYWSWIRQPPGKGLEWIGYIYYSGSTNYNPS
LKSRVTISIVTSRNQFSLKLSSVTAADTAVYYCARSALRYFDWLFSDVSDIWGQGTMVTVSSAS
TKGPSVFPLAPCSRSTSESTAALGCLVKDYFPEPVTVSWNSGALTSGVHTFPAVLQSSGLYSLS
SVVTVPSSNFGTQTYTCNVDHKPSNTKVDKTVERKCCVECPPCPAPPVAGPSVFLFPPKPKDTL
MISRTPEVTCVVVDVSHEDPEVQFNWYVDGVEVHNAKTKPREEQFNSTFRVVSVLTVVHQDWLN
GKEYKCKVSNKGLPAPIEKTISKTKGQPREPQVYTLPPSREEMTKNQVSLTCLVKGFYPSDIAV
EWESNGQPENNYKTTPPMLDSDGSFFLYSKLTVDKSRWQQGNVFSCSVMHEALHNHYTQKSLSL
SPGK U$_H$-54 heavy chain amino acid sequence (SEQ ID NO:90)
EVQLVQSGAELKKPGESLKISCKGSGYRFTSYWIGWVRQMPGKGLEWMGIIYPDDSDTRYSPSF
QGQVTISADKSISTAYLQWSSLKASDTAMYYCARQKSYGYSYFDYWGQGTLVTVSSASTKGPSV
FPLAPCSRSTSESTAALGCLVKDYFPEPVTVSWNSGALTSGVHTFPAVLQSSGLYSLSSVVTVP
SSNFGTQTYTCNVDHKPSNTKVDKTVERKCCVECPPCPAPPVAGPSVFLFPPKPKDTLMISRTP
EVTCVVVDVSHEDPEVQFNWYVDGVEVHNAKTKPREEQFNSTFRVVSVLTVVHQDWLNGKEYKC
KVSNKGLPAPIEKTISKTKGQPREPQVYTLPPSREEMTKNQVSLTCLVKGFYPSDIAVEWESNG
QPENNYKTTPPMLDSDGSFFLYSKLTVDKSRWQQGNVFSCSVMHEALHNHYTQKSLSLSPGK U$_H$-55 heavy chain amino acid sequence (SEQ ID NO:91)
EVQLVQSGAEVKKPGESLKISCKGSGYSFTSYWIGWVRQMPGKGLEWMGIIYPDDSDARYSPSF
QGQVTISADKSINTAYLQWSSLKASDTAMYYCARQGYGSGWGYFDYWGQGTLVTVSSASTKGPS
VFPLAPCSRSTSESTAALGCLVKDYFPEPVTVSWNSGALTSGVHTFPAVLQSSGLYSLSSVVTV
PSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYK
CKVSNKGLPAPIEKTISKTKGQPREPQVYTLPPSREEMTKNQVSLTCLVKGFYPSDIAVEWESN
GQPENNYKTTPPMLDSDGSFFLYSKLTVDKSRWQQGNVFSCSVMHEALHNHYTQKSLSLSPGK U$_H$-56 heavy chain amino acid sequence (SEQ ID NO:92)
EVQLVQSGAEVKKPGESLKISCKGSGYSFTSYWIGWVRQMPGKGLEWMGIIYPGDSDIRYSPSF
QGQVTISADKSISTAYLQWSSLKASDTAMYYCARQGLAVAGTSYYYYGMDVWGQGTTVTVSSA
STKGPSVFPLAPCSRSTSESTAALGCLVKDYFPEPVTVSWNSGALTSGVHTFPAVLQSSGLYSL
SSVVTVPSSNFGTQTYTCNVDHKPSNTKVDKTVERKCCVECPPCPAPPVAGPSVFLFPPKPKDT
LMISRTPEVTCVVVDVSHEDPEVQFNWYVDGVEVHNAKTKPREEQFNSTFRVVSVLTVVHQDWL
NGKEYKCKVSNKGLPAPIEKTISKTKGQPREPQVYTLPPSREEMTKNQVSLTCLVKGFYPSDIA
VEWESNGQPENNYKTTPPMLDSDGSFFLYSKLTVDKSRWQQGNVFSCSVMHEALHNHYTQKSLS
LSPGK

FIGURE 4N

U<sub>H</sub>-57 heavy chain amino acid sequence (SEQ ID NO:93)
QVQLQQSGPGLVKPSQTLSLTCAISGDSVSSYSAAWNWIRQSPSRGLEWLGRTYCRSKWYNDYA
VSVKSRITINPDTSKNQFSLQLNSVTPEDTAVYYCARDRAVAGYYYGMDVWGQGTTVTVSSASTK
GPSVFPLAPCSRSTSESTAALGCLVKDYFPEPVTVSWNSGALTSGVHTFPAVLQSSGLYSLSSV
VTVPSSNFGTQTYTCNVDHKPSNTKVDKTVERKCCVECPPCPAPPVAGPSVFLFPPKPKDTLMI
SRTPEVTCVVVDVSHEDPEVQFNWYVDGVEVHNAKTKPREEQFNSTFRVVSVLTVVHQDWLNGK
EYKCKVSNKGLPAPIEKTISKTKGQPREPQVYTLPPSREEMTKNQVSLTCLVKGFYPSDIAVEW
ESNGQPENNYKTTPPMLDSDGSFFLYSKLTVDKSRWQQGNVFSCSVMHEALHNHYTQKSLSLSP
GK U<sub>H</sub>-58 heavy chain amino acid sequence (SEQ ID NO:73)
EVQLVESGGGLVQPGGSLRLSCAASGFTFSAYSMNWVRQAPGKGLEWVSYISSSGRTIYYADSV
KGRFTISRDNAKNSLFLQMNSLRDEDTAVYYCALWAPFDYWGQGTLVTVSSASTKGPSVFPLAP
CSRSTSESTAALGCLVKDYFPEPVTVSWNSGALTSGVHTFPAVLQSSGLYSLSSVVTVPSSNFG
TQTYTCNVDHKPSNTKVDKTVERKCCVECPPCPAPPVAGPSVFLFPPKPKDTLMISRTPEVTCV
VVDVSHEDPEVQFNWYVDGVEVHNAKTKPREEQFNSTFRVVSVLTVVHQDWLNGKEYKCKVSNK
GLPAPIEKTISKTKGQPREPQVYTLPPSREEMTKNQVSLTCLVKGFYPSDIAVEWESNGQPENN
YKTTPPMLDSDGSFFLYSKLTVDKSRWQQGNVFSCSVMHEALHNHYTQKSLSLSPGK

FIGURE 40

CONSTANT REGION: LIGHT CHAIN AMINO ACID SEQUENCE

RTVAAPSVFIFPPSDEQLKSGTASVVCLLNNFYPREAKVQWKVDNALQSGNSQESVTEQDSKDSTYSLSSTLTLSKA
DYEKHKVYACEVTHQGLSSPVTKSFNRGEC (SEQ ID NO:187)

FIGURE 5A

CONSTANT REGION: HEAVY CHAIN AMINO ACID SEQUENCE

ASTKGPSVFPLAPCSRSTSESTAALGCLVKDYFPEPVTVSWNSGALTSGVHTFPAVLQSSGLYSLSSVVTVPSSNFG
TQTYTCNVDHKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQPREPQVYTLP
PSREEMTKNQVSLTCLVKGFYPSDIAVEWESNGQPENNYKTTPPMLDSDGSFFLYSKLTVDKSRWQQGNVFSCSVMH
EALHNHYTQKSLSLSPGK (SEQ ID NO:188)

FIGURE 5B

LIGHT CHAIN CDRS

| NAME | SEQUENCE | SEQ ID NO: |
|---|---|---|
| CDRL1-1 | RSSQSLVYSDGNTYLN | 189 |
| CDRL1-2 | RSSQSLVYSDGNTYLN | 189 |
| CDRL1-3 | RSSQSLVYSDGNTYLN | 189 |
| CDRL1-4 | RSSQSLVYSDGNTYLN | 189 |
| CDRL1-5 | KSSQSLLHSDGKTYLY | 190 |
| CDRL1-6 | KSSQSLLHSDGKTYLY | 190 |
| CDRL1-7 | KSSQSLLHSDGKTYLY | 190 |
| CDRL1-8 | KSSQSLLHSDGKTYLY | 190 |
| CDRL1-9 | KSSQSLLHSDGKTYLY | 190 |
| CDRL1-11 | RASQGIANYLA | 191 |
| CDRL1-12 | RASQGISNDLA | 192 |
| CDRL1-13 | RSSQSLVHSDGNTYLS | 193 |
| CDRL1-14 | RSSQSLVHSDGNTYLS | 193 |
| CDRL1-15 | RSSQSLVHSDGNTYLS | 193 |
| CDRL1-16 | RASQTVISSYLA | 194 |
| CDRL1-17 | RASQSVSRLA | 195 |
| CDRL1-18 | RASQGIRNDLG | 196 |
| CDRL1-19 | KSSQSVLYSSNNKNYLV | 197 |
| CDRL1-20 | KSSQSVLYSSNNKNYLV | 197 |
| CDRL1-21 | KSSQSVLYSSNNKNYLA | 198 |
| CDRL1-22 | KSSQNVLYSSNNKNYLA | 199 |
| CDRL1-23 | KSSQNVLYSSNNKNYLA | 199 |
| CDRL1-24 | KSSQSVLYSSNNKNYLA | 198 |
| CDRL1-25 | KSSQSVLYSSNNKNYLA | 198 |
| CDRL1-26 | KSSQSVLYNSNNKNYLA | 200 |
| CDRL1-27 | KSSQSVLYNSNNKNYLA | 200 |
| CDRL1-28 | KSSQSVLYSSNNKNYLA | 198 |
| CDRL1-29 | KSSQSVLYSSNNKNYLA | 198 |
| CDRL1-30 | KSSQSVLDSSNNKNYLA | 201 |
| CDRL1-31 | KSSQSVLDSSNNKNYLA | 201 |
| CDRL1-32 | KSSQSILYRSNNKNYLA | 202 |
| CDRL1-33 | KSSQSILYRSNNKNYLA | 202 |
| CDRL1-34 | RASQDISHYLA | 203 |
| CDRL1-35 | RASQDISNYLA | 204 |

FIGURE 6A

| NAME | SEQUENCE | SEQ ID NO: |
|---|---|---|
| CDRL1-36 | RASQSVSSNLA | 205 |
| CDRL1-37 | RASQSVSSNLA | 205 |
| CDRL1-38 | RASQDISRWLA | 206 |
| CDRL1-39 | RASQSISTYLN | 207 |
| CDRL1-40 | RASQTISIYLN | 208 |
| CDRL1-41 | RASQSIRSYLN | 209 |
| CDRL1-42 | RASQTISRYLN | 210 |
| CDRL1-43 | RASQRISSYLN | 211 |
| CDRL1-44 | RASQSISRYLN | 212 |
| CDRL1-45 | RASQSISSYLN | 213 |
| CDRL1-46 | RASQSISSYLN | 213 |
| CDRL1-47 | RASQSISSYLN | 213 |
| CDRL1-48 | RASQSISSYLN | 213 |
| CDRL1-49 | RASQSISSYLN | 213 |
| CDRL1-50 | RASQSISSYLN | 213 |
| CDRL1-51 | RASQSISSYLN | 213 |
| CDRL1-52 | RASQSISSYLN | 213 |
| CDRL1-53 | RASQSISSYLN | 213 |
| CDRL1-54 | QASQDISNYLN | 214 |
| CDRL1-55 | QASQDISNYLN | 214 |
| CDRL1-56 | QASQDISNSLN | 215 |
| CDRL1-57 | QASQDISDYLN | 216 |
| CDRL1-58 | QASQDISNYLN | 214 |
| CDRL1-59 | QASQDISNYLN | 214 |
| CDRL1-60 | QASQDISNSLN | 215 |
| CDRL1-61 | QASQDISNSLN | 215 |
| CDRL1-62 | QASQDITNYLN | 217 |
| CDRL1-63 | QASQDISNYLN | 214 |
| CDRL1-64 | QASQDISDYLN | 216 |
| CDRL1-65 | QASQDISNSLN | 215 |
| CDRL2-1 | KVSNWDS | 218 |
| CDRL2-2 | KVSNWDS | 218 |
| CDRL2-3 | KVSNWDS | 218 |
| CDRL2-4 | KVSNWDS | 218 |
| CDRL2-5 | EVSNRFS | 219 |
| CDRL2-6 | EVSNRFS | 219 |

FIGURE 6B

| NAME | SEQUENCE | SEQ ID NO: |
|---|---|---|
| CDRL2-7 | EVSNRFS | 219 |
| CDRL2-8 | EVSNRFS | 219 |
| CDRL2-9 | EVSNRFS | 219 |
| CDRL2-11 | VASTLQS | 220 |
| CDRL2-12 | AASTLQS | 221 |
| CDRL2-13 | KISNRFS | 222 |
| CDRL2-14 | KISNRFS | 222 |
| CDRL2-15 | KISNRFS | 222 |
| CDRL2-16 | GASSRAT | 223 |
| CDRL2-17 | GASRRAT | 224 |
| CDRL2-18 | AASSLQS | 225 |
| CDRL2-19 | WASTRES | 226 |
| CDRL2-20 | WASTRES | 226 |
| CDRL2-21 | WASTRES | 226 |
| CDRL2-22 | WASTRES | 226 |
| CDRL2-23 | WASTRES | 226 |
| CDRL2-24 | WASTRES | 226 |
| CDRL2-25 | WASTRES | 226 |
| CDRL2-26 | WASTRES | 226 |
| CDRL2-27 | WASTRES | 226 |
| CDRL2-28 | WASTRKS | 227 |
| CDRL2-29 | WASTRKS | 227 |
| CDRL2-30 | WASTRES | 226 |
| CDRL2-31 | WASTRES | 226 |
| CDRL2-32 | WASARES | 228 |
| CDRL2-33 | WASARES | 228 |
| CDRL2-34 | AASSLQS | 225 |
| CDRL2-35 | AASSLQS | 225 |
| CDRL2-36 | GASRRAT | 224 |
| CDRL2-37 | GASRRAT | 224 |
| CDRL2-38 | AASSLQS | 225 |
| CDRL2-39 | AASSLQS | 225 |
| CDRL2-40 | AASSLQS | 225 |
| CDRL2-41 | AASSLQS | 225 |
| CDRL2-42 | AASTLQS | 221 |
| CDRL2-43 | AESSLQS | 229 |

FIGURE 6C

| NAME | SEQUENCE | SEQ ID NO: |
|---|---|---|
| CDRL2-44 | TASSLQS | 230 |
| CDRL2-45 | TASSLQS | 230 |
| CDRL2-46 | TASSLQS | 230 |
| CDRL2-47 | TASSLQS | 230 |
| CDRL2-48 | TVSSLQS | 231 |
| CDRL2-49 | TVSSLQS | 231 |
| CDRL2-50 | TVSSLQS | 231 |
| CDRL2-51 | TASSLQS | 230 |
| CDRL2-52 | TASSLQS | 230 |
| CDRL2-53 | TASSLQS | 230 |
| CDRL2-54 | DASNLET | 232 |
| CDRL2-55 | DASNLET | 232 |
| CDRL2-56 | DASNLET | 232 |
| CDRL2-57 | DASNLET | 232 |
| CDRL2-58 | DASNLET | 232 |
| CDRL2-59 | DASNLET | 232 |
| CDRL2-60 | DASILET | 233 |
| CDRL2-61 | DASNLET | 232 |
| CDRL2-62 | DASNLET | 232 |
| CDRL2-63 | DASNLET | 232 |
| CDRL2-64 | DASNLET | 232 |
| CDRL2-65 | DASNLET | 232 |
| CDRL3-1 | MQSTHWPIT | 234 |
| CDRL3-2 | IQGTHWPTT | 235 |
| CDRL3-3 | MQGTHWPIT | 236 |
| CDRL3-4 | MQGTHWPIT | 236 |
| CDRL3-5 | MQGIQLPCS | 237 |
| CDRL3-6 | MQSIQLPLT | 238 |
| CDRL3-7 | MQSIQLPLT | 238 |
| CDRL3-8 | MQSIQLPIT | 239 |
| CDRL3-9 | MQSIQLPIT | 239 |
| CDRL3-11 | QNYNSAPFT | 240 |
| CDRL3-12 | QKYNSVPLT | 241 |
| CDRL3-13 | MQATQFPHT | 242 |
| CDRL3-14 | MQATQFPHT | 242 |
| CDRL3-15 | MQATQFPHT | 242 |

FIGURE 6D

| NAME | SEQUENCE | SEQ ID NO: |
|---|---|---|
| CDRL3-16 | QQYGSSPRT | 243 |
| CDRL3-17 | QQYGSSPRS | 244 |
| CDRL3-18 | LQHNSYPPT | 245 |
| CDRL3-19 | QQYYSFPWT | 246 |
| CDRL3-20 | QQYYSFPWT | 246 |
| CDRL3-21 | QQYYSTTWT | 247 |
| CDRL3-22 | QQYYGTPRT | 248 |
| CDRL3-23 | QQYYGTPRT | 248 |
| CDRL3-24 | QQYYSISRT | 249 |
| CDRL3-25 | QQYYSISRT | 249 |
| CDRL3-26 | QQYYSTTWT | 247 |
| CDRL3-27 | QQYYSTTWT | 247 |
| CDRL3-28 | QQYYSTMFS | 250 |
| CDRL3-29 | QQYYSTMFS | 250 |
| CDRL3-30 | HQYYSTPLT | 251 |
| CDRL3-31 | HQYYSTPLT | 251 |
| CDRL3-32 | QQYFITPLT | 252 |
| CDRL3-33 | QQYFITPLT | 252 |
| CDRL3-34 | QQYNNYPFT | 253 |
| CDRL3-35 | QQYNTYPFT | 254 |
| CDRL3-36 | QQHNNWPPWT | 255 |
| CDRL3-37 | QQHNNWPPWT | 255 |
| CDRL3-38 | QQANSFPPT | 256 |
| CDRL3-39 | QQSHSAPFT | 257 |
| CDRL3-40 | QQSYSTLT | 258 |
| CDRL3-41 | QQSYSIPLT | 259 |
| CDRL3-42 | QQIYSTSIT | 260 |
| CDRL3-43 | QQSYITPIT | 261 |
| CDRL3-44 | QQSYFTPIT | 262 |
| CDRL3-45 | QQSYFSPIT | 263 |
| CDRL3-46 | QQSFYTPIT | 264 |
| CDRL3-47 | QQSFYTPIT | 264 |
| CDRL3-48 | QQSYFTPIT | 262 |
| CDRL3-49 | QQSYFTPIT | 262 |
| CDRL3-50 | QQSYFTPIT | 262 |
| CDRL3-51 | QQSFYAPIT | 265 |

FIGURE 6E

| NAME | SEQUENCE | SEQ ID NO: |
|---|---|---|
| CDRL3-52 | QQSFYAPIT | 265 |
| CDRL3-53 | QQSYFTPIT | 262 |
| CDRL3-54 | QQYDYLPFT | 266 |
| CDRL3-55 | QQYDYLPFT | 266 |
| CDRL3-56 | QQCDDLPLT | 267 |
| CDRL3-57 | QHYDNLPLT | 268 |
| CDRL3-58 | QQYDNLPLT | 269 |
| CDRL3-59 | QQYDNLPLT | 269 |
| CDRL3-60 | QQCDILPLS | 270 |
| CDRL3-61 | QQYDNLPLA | 271 |
| CDRL3-62 | QQYDSLPIT | 272 |
| CDRL3-63 | QQYDNLPIT | 273 |
| CDRL3-64 | QHYDNLPIT | 274 |
| CDRL3-65 | QHYDNLPIT | 274 |

FIGURE 6F

HEAVY CHAIN CDRS

| NAME | NAME | SEQUENCE | SEQ ID NO: |
|---|---|---|---|
| CDRH1-1 | CDRH1-10.1 | GYTFTSYGIS | 275 |
| CDRH1-2 | CDRH1-10 | GYTFTSYGIS | 275 |
| CDRH1-3 | CDRH1-42 | GYTFTGHYMH | 276 |
| CDRH1-4 | CDRH1-40 | GYTFTGYYMH | 277 |
| CDRH1-5 | CDRH1-30 | GYTLTELSMH | 278 |
| CDRH1-6 | CDRH1-31 | GYTLTELSMH | 278 |
| CDRH1-7 | CDRH1-29 | GFSLSNARMGVS | 279 |
| CDRH1-8 | CDRH1-20 | GFSLSNARMGVS | 279 |
| CDRH1-9 | CDRH1-65 | GFSLSTGGVGVG | 280 |
| CDRH1-10 | CDRH1-56 | GFSLSTGGVGVG | 280 |
| CDRH1-11 | CDRH1-62 | GFSLNTGGVGVG | 281 |
| CDRH1-12 | CDRH1-2 | GFSLSTGGVGVG | 280 |
| CDRH1-13 | CDRH1-59 | GFSLSTGGVGVG | 280 |
| CDRH1-14 | CDRH1-57 | GFSLSTGGVGVG | 280 |
| CDRH1-15 | CDRH1-64 | GFSLSTGGVGVG | 280 |
| CDRH1-16 | CDRH1-41 | GFPFSRYSMN | 282 |
| CDRH1-17 | CDRH1-45 | GFTFSSYAMN | 283 |
| CDRH1-18 | CDRH1-47 | GFTFSSYAMS | 284 |
| CDRH1-19 | CDRH1-51 | GFTFSSYAMS | 284 |
| CDRH1-20 | CDRH1-52 | GFTFSSYAMS | 284 |
| CDRH1-21 | CDRH1-13 | GFTFSSYGMH | 285 |
| CDRH1-22 | CDRH1-14 | GFTFSSYGMH | 285 |
| CDRH1-23 | CDRH1-1 | GFTFSSYGMH | 285 |
| CDRH1-24 | CDRH1-22 | GFTFSSYDMH | 286 |
| CDRH1-25 | CDRH1-23 | GFTFSSYDMH | 286 |
| CDRH1-26 | CDRH1-12 | GFTFSSYGMH | 285 |
| CDRH1-27 | CDRH1-5 | GFTFSSYGMH | 285 |
| CDRH1-28 | CDRH1-15 | GFTFSSYGMH | 285 |
| CDRH1-29 | CDRH1-7 | GFTFSSYGMH | 285 |
| CDRH1-30 | CDRH1-61 | GFTFRSHGMH | 287 |
| CDRH1-31 | CDRH1-39 | GFTFSAYSMN | 288 |
| CDRH1-32 | CDRH1-34 | GFTFSSYSMN | 289 |
| CDRH1-33 | CDRH1-6 | GFTFSSYSMN | 289 |
| CDRH1-34 | CDRH1-35 | GFTFSSYSMN | 289 |
| CDRH1-35 | CDRH1-21 | GGSVSSGGYYWS | 290 |
| CDRH1-36 | CDRH1-8 | GGSISRGGYYWS | 291 |
| CDRH1-37 | CDRH1-9 | GGSISRGGYYWS | 291 |
| CDRH1-38 | CDRH1-18 | GGSISSGGYYWS | 292 |

FIGURE 7A

| NAME | NAME | SEQUENCE | SEQ ID NO: |
|---|---|---|---|
| CDRH1-39 | CDRH1-24 | GGSISSGGYYWS | 292 |
| CDRH1-40 | CDRH1-25 | GGSISSGGYYWS | 292 |
| CDRH1-41 | CDRH1-26 | GGSISSGGYYWS | 292 |
| CDRH1-42 | CDRH1-27 | GGSISSGGYYWS | 292 |
| CDRH1-43 | CDRH1-38 | GGSISSGGYYWS | 292 |
| CDRH1-44 | CDRH1-54 | GGSISSGDYYWN | 293 |
| CDRH1-45 | CDRH1-55 | GGSISSGDYYWN | 293 |
| CDRH1-46 | CDRH1-43 | GGSFSGYYWS | 294 |
| CDRH1-47 | CDRH1-44 | GGSFSGYYWS | 294 |
| CDRH1-48 | CDRH1-49 | GGSFSGYYWS | 294 |
| CDRH1-49 | CDRH1-50 | GGSFSGYYWS | 294 |
| CDRH1-50 | CDRH1-53 | GGSFSGYYWS | 294 |
| CDRH1-51 | CDRH1-33 | GGSISSYYWS | 295 |
| CDRH1-52 | CDRH1-3 | GGSVSSGGSYWS | 296 |
| CDRH1-53 | CDRH1-4 | GGSVSSGGSYWS | 296 |
| CDRH1-54 | CDRH1-16 | GYRFTSYWIG | 297 |
| CDRH1-55 | CDRH1-17 | GYSFTSYWIG | 298 |
| CDRH1-56 | CDRH1-11 | GYSFTSYWIG | 298 |
| CDRH1-57 | CDRH1-37 | GDSVSSYSAAWN | 299 |
| CDRH1-58 | CDRH1-39.1 | GFTFSAYSMN | 288 |
| CDRH2-1 | CDRH2-10.1 | WISASNGNTNYAQKLQD | 300 |
| CDRH2-2 | CDRH2-10 | WISASNGNTNYAQKLQD | 300 |
| CDRH2-3 | CDRH2-42 | WINPNSGGTNCAQKFQG | 301 |
| CDRH2-4 | CDRH2-40 | WINPNSGGTNHTQKFQG | 302 |
| CDRH2-5 | CDRH2-30 | SFDPEDGETIYAQKFQG | 303 |
| CDRH2-6 | CDRH2-31 | SFDPEDGETIYAQKFQG | 303 |
| CDRH2-7 | CDRH2-29 | HIFSNDEKSYSTSLKS | 304 |
| CDRH2-8 | CDRH2-20 | LIFSNDEKSYSTSLKS | 305 |
| CDRH2-9 | CDRH2-65 | LIYWNDDKRYSPSLKS | 306 |
| CDRH2-10 | CDRH2-56 | LIYWNDDKRYSPSLKS | 306 |
| CDRH2-11 | CDRH2-62 | LIYWNDDKRYSPSLKS | 306 |
| CDRH2-12 | CDRH2-2 | LIYWNDDKRYSPSLKS | 306 |
| CDRH2-13 | CDRH2-59 | LIYWNVEKRYSPSLRS | 307 |
| CDRH2-14 | CDRH2-57 | LIYWNDDKRYSPSLKS | 306 |
| CDRH2-15 | CDRH2-64 | LIYWNDDKRYSPSLKS | 306 |
| CDRH2-16 | CDRH2-41 | AISSSSSYIYYADSVKG | 308 |
| CDRH2-17 | CDRH2-45 | AISGSGGSTYYADSVKG | 309 |
| CDRH2-18 | CDRH2-47 | AISGSGGSTYYADSVKG | 309 |
| CDRH2-19 | CDRH2-51 | AISGSGGSTYYADSVKG | 309 |
| CDRH2-20 | CDRH2-52 | AISGSGGSTYYADSVKG | 309 |

FIGURE 7B

| NAME | NAME | SEQUENCE | SEQ ID NO: |
|---|---|---|---|
| CDRH2-21 | CDRH2-13 | FISDDGSTKYYADSVKG | 310 |
| CDRH2-22 | CDRH2-14 | FISDDGSTKYYADSVKG | 310 |
| CDRH2-23 | CDRH2-1 | VIWYDGSNKYYADSVKG | 311 |
| CDRH2-24 | CDRH2-22 | VIWYDGSIKYYADSVKG | 312 |
| CDRH2-25 | CDRH2-23 | VIWYDGSIKYYADSVKG | 312 |
| CDRH2-26 | CDRH2-12 | VIWYDGSNKYYADSVKG | 311 |
| CDRH2-27 | CDRH2-5 | VIWSDGSNKYYADSVKG | 313 |
| CDRH2-28 | CDRH2-15 | VIWDDGSNQYYTDSVKG | 314 |
| CDRH2-29 | CDRH2-7 | VIWYDGSNKRYVDSVKG | 315 |
| CDRH2-30 | CDRH2-61 | VIWYDGSNKNYADSVRG | 316 |
| CDRH2-31 | CDRH2-39 | YISSSGRTIYYADSVKG | 317 |
| CDRH2-32 | CDRH2-34 | HISSSSRTIYYADSVKG | 318 |
| CDRH2-33 | CDRH2-6 | HISRSSRTIYYADSVKG | 319 |
| CDRH2-34 | CDRH2-35 | HISRSSRTIYYADSVKG | 319 |
| CDRH2-35 | CDRH2-21 | YIHSSGSTYYNPSLKS | 320 |
| CDRH2-36 | CDRH2-8 | YIYHSGSTYYNPSLKS | 321 |
| CDRH2-37 | CDRH2-9 | YIYHSGSTYYNPSLKS | 321 |
| CDRH2-38 | CDRH2-18 | YIYYSGSTYYNPSLKS | 322 |
| CDRH2-39 | CDRH2-24 | YIHYSGSTYYNPSLKS | 323 |
| CDRH2-40 | CDRH2-25 | YIHYSGSTYYNPSLKS | 323 |
| CDRH2-41 | CDRH2-26 | YIHSSGSTYYNPSLKS | 320 |
| CDRH2-42 | CDRH2-27 | YIHSSGSTYYNPSLKS | 320 |
| CDRH2-43 | CDRH2-38 | YIHYSGSTYYNPSLKS | 323 |
| CDRH2-44 | CDRH2-54 | YIYYSGGTYYNPSLKS | 324 |
| CDRH2-45 | CDRH2-55 | YIYYSGGTYYNPSLKS | 324 |
| CDRH2-46 | CDRH2-43 | EINHSGSTNYNPSLKS | 325 |
| CDRH2-47 | CDRH2-44 | EINHSGSTNYNPSLKS | 325 |
| CDRH2-48 | CDRH2-49 | EINHSGSTNYNPSLKS | 325 |
| CDRH2-49 | CDRH2-50 | EINHSGSTNYNPSLKS | 325 |
| CDRH2-50 | CDRH2-53 | EINHSGSTNYNPSLKS | 325 |
| CDRH2-51 | CDRH2-33 | RIYTSGTTNYNPSLKS | 326 |
| CDRH2-52 | CDRH2-3 | YIYYSGSTNYNPSLKS | 327 |
| CDRH2-53 | CDRH2-4 | YIYYSGSTNYNPSLKS | 327 |
| CDRH2-54 | CDRH2-16 | IIYPDDSDTRYSPSFQG | 328 |
| CDRH2-55 | CDRH2-17 | IIYPDDSDARYSPSFQG | 329 |
| CDRH2-56 | CDRH2-11 | IIYPGDSDIRYSPSFQG | 330 |
| CDRH2-57 | CDRH2-37 | RTYCRSKWYNDYAVSVKS | 331 |
| CDRH2-58 | CDRH2-39.1 | YISSSGRTIYYADSVKG | 317 |
| CDRH3-1 | CDRH3-10.1 | EDNWNYGFFDY | 332 |
| CDRH3-2 | CDRH3-10 | EDNWNYGFFDY | 332 |

FIGURE 7C

| NAME | NAME | SEQUENCE | SEQ ID NO: |
|---|---|---|---|
| CDRH3-3 | CDRH3-42 | SIAVALDY | 333 |
| CDRH3-4 | CDRH3-40 | SIAVALDY | 333 |
| CDRH3-5 | CDRH3-30 | EGDGGYYYYGMDV | 334 |
| CDRH3-6 | CDRH3-31 | EGDGGYYYYGMDV | 334 |
| CDRH3-7 | CDRH3-29 | MYSSGWYGVFDY | 335 |
| CDRH3-8 | CDRH3-20 | VYSSGWSFYGMDV | 336 |
| CDRH3-9 | CDRH3-65 | RRELPFDY | 337 |
| CDRH3-10 | CDRH3-56 | RNWTPFDY | 338 |
| CDRH3-11 | CDRH3-62 | RLELPFDY | 339 |
| CDRH3-12 | CDRH3-2 | RREVPFDY | 340 |
| CDRH3-13 | CDRH3-59 | RHTNPFEY | 341 |
| CDRH3-14 | CDRH3-57 | RGELPFDY | 342 |
| CDRH3-15 | CDRH3-64 | RGELPFDY | 342 |
| CDRH3-16 | CDRH3-41 | DRVGATPDAFDI | 343 |
| CDRH3-17 | CDRH3-45 | EGIAVAGTAEYYYYYAMDV | 344 |
| CDRH3-18 | CDRH3-47 | EGIAARDSYYYYAMDV | 345 |
| CDRH3-19 | CDRH3-51 | EGIAGRDSYYYYGMDV | 346 |
| CDRH3-20 | CDRH3-52 | EGIAGRDSYYYYGMDV | 346 |
| CDRH3-21 | CDRH3-13 | SYYDSSGYYYGFDY | 347 |
| CDRH3-22 | CDRH3-14 | SYYDSSGYYYGFDY | 347 |
| CDRH3-23 | CDRH3-1 | NVIDY | 348 |
| CDRH3-24 | CDRH3-22 | GGATGAEYFQH | 349 |
| CDRH3-25 | CDRH3-23 | GGATGAEYFQH | 349 |
| CDRH3-26 | CDRH3-12 | LWFGETFDY | 350 |
| CDRH3-27 | CDRH3-5 | NLPFDY | 351 |
| CDRH3-28 | CDRH3-15 | SHYGGDYDYYGMDV | 352 |
| CDRH3-29 | CDRH3-7 | DGWQQQAPFDY | 353 |
| CDRH3-30 | CDRH3-61 | WGISAPFDC | 354 |
| CDRH3-31 | CDRH3-39 | WAPFDY | 355 |
| CDRH3-32 | CDRH3-34 | DGYNWNGGGNYYGMDV | 356 |
| CDRH3-33 | CDRH3-6 | DGYNWNNGGYYYGMDV | 357 |
| CDRH3-34 | CDRH3-35 | DGYNWNNGGYYYGMDV | 357 |
| CDRH3-35 | CDRH3-21 | GPYYGMDV | 358 |
| CDRH3-36 | CDRH3-8 | ALRGIVLMVYVLGALDI | 359 |
| CDRH3-37 | CDRH3-9 | ALRGIVLMVYVLGALDI | 359 |
| CDRH3-38 | CDRH3-18 | DETVVRGLIRYCYGMDV | 360 |
| CDRH3-39 | CDRH3-24 | DRGGGDYGRMDV | 361 |
| CDRH3-40 | CDRH3-25 | DRGGGDYGRMDV | 361 |
| CDRH3-41 | CDRH3-26 | SNNYGCFAL | 362 |
| CDRH3-42 | CDRH3-27 | SNNYGCFAL | 362 |

FIGURE 7D

| NAME | NAME | SEQUENCE | SEQ ID NO: |
|---|---|---|---|
| CDRH3-43 | CDRH3-38 | GYNYGLYYYDSSGYPSYYYGMDV | 363 |
| CDRH3-44 | CDRH3-54 | TYYDILTGYPFYFDY | 364 |
| CDRH3-45 | CDRH3-55 | TYYDILTGYPFYFDY | 364 |
| CDRH3-46 | CDRH3-43 | GGYSSSWYWFDP | 365 |
| CDRH3-47 | CDRH3-44 | GGYSSSWFWFDP | 366 |
| CDRH3-48 | CDRH3-49 | GGYSSSWFWFDP | 366 |
| CDRH3-49 | CDRH3-50 | GGYSSSWFWFDP | 366 |
| CDRH3-50 | CDRH3-53 | GGYSSSWFWFDP | 366 |
| CDRH3-51 | CDRH3-33 | DGYSYGHYYYYGMDV | 367 |
| CDRH3-52 | CDRH3-3 | SALRYFDWLFSDVSDI | 368 |
| CDRH3-53 | CDRH3-4 | SALRYFDWLFSDVSDI | 368 |
| CDRH3-54 | CDRH3-16 | QKSYGYSYFDY | 369 |
| CDRH3-55 | CDRH3-17 | QGYGSGWGYFDY | 370 |
| CDRH3-56 | CDRH3-11 | QGLAVAGTSYYYYYGMDV | 371 |
| CDRH3-57 | CDRH3-37 | DRAVAGYYYGMDV | 372 |
| CDRH3-58 | CDRH3-39.1 | WAPFDY | 355 |

FIGURE 7E

LIGHT CHAIN FRS

| NAME | SEQUENCE | SEQ ID NO: |
|---|---|---|
| FRL1-1 | DVVMTQSPLSLPVTLGQPASISC | 388 |
| FRL1-2 | DVVMTQSPLSLPVTLGQPASISC | 388 |
| FRL1-3 | DVVMTQSPLSLPVTLGQPASISC | 389 |
| FRL1-4 | DVVMTQSPLSLPVTLGQPASISC | 389 |
| FRL1-5 | DIVMTQTPLSLSVTPGQPASISC | 390 |
| FRL1-6 | DIVMTQTPLSLSVTPGQPASISC | 390 |
| FRL1-7 | DIVMTQTPLSLSVTPGQPASISC | 390 |
| FRL1-8 | DIVMTQTPLSLSVTPGQPASISC | 391 |
| FRL1-9 | DIVMTQTPLSLSVTPGQPASISC | 391 |
| FRL1-11 | DIQMTQSPSSLSASVGDRVTITC | 392 |
| FRL1-12 | DIQMTQSPSSLSASVGDRVTIIC | 392 |
| FRL1-13 | NIVMTQTPLSSPVTLGQPASISC | 393 |
| FRL1-14 | NIVMTQTPLSSPVTLGQPASISC | 393 |
| FRL1-15 | EIVMTQTPLSSPVTLGQPASISC | 393 |
| FRL1-16 | EIVLTQSPGTLSLSPGERATLSC | 394 |
| FRL1-17 | EIVLTQSPGTLSLSPGERATLSC | 395 |
| FRL1-18 | DIQMTQSPSSLSASVGDRVTITC | 396 |
| FRL1-19 | DIVMTQSPDSLAVSLGERATINC | 397 |
| FRL1-20 | DIVMTQSPDSLAVSLGERATINC | 397 |
| FRL1-21 | DIVMTQSPDSLAVSLGERATINC | 398 |
| FRL1-22 | DIVMTQSPDSLAVSLGERATINC | 398 |
| FRL1-23 | DIVMTQSPDSLAVSLGERATINC | 398 |
| FRL1-24 | DIVMTQSPDSLTVSLGERATINC | 398 |
| FRL1-25 | DIVMTQSPDSLTVSLGERATINC | 398 |
| FRL1-26 | DIVMTQSPDSLAVSLGERATINC | 398 |
| FRL1-27 | DIVMTQSPDSLAVSLGERATINC | 398 |
| FRL1-28 | DIVMTQSPDSLAVSLGERATINC | 399 |
| FRL1-29 | DIVMTQSPDSLAVSLGERATINC | 399 |
| FRL1-30 | DIVMTQSPDSLAVSLGERATINC | 398 |
| FRL1-31 | DIVMTQSPDSLAVSLGERATINC | 398 |
| FRL1-32 | DIVMTQSPDSLAVSLGERATINC | 398 |
| FRL1-33 | DIVMTQSPDSLAVSLGERATINC | 398 |
| FRL1-34 | DIQMTQSPSSLSASVGDRVTITC | 400 |
| FRL1-35 | DIQMTQSPSSLSASVGDRVAITC | 401 |

FIGURE 8A

| NAME | SEQUENCE | SEQ ID NO: |
|---|---|---|
| FRL1-36 | EIVMTQSPATLSVSPGERATLSC | 402 |
| FRL1-37 | EIVMTQSPATLSVSPGERATLSC | 402 |
| FRL1-38 | DIQMTQSPSSVSASVGDRVTITC | 403 |
| FRL1-39 | DIQMTQSPSSLSASVGDRVTITC | 404 |
| FRL1-40 | DIQMTQSPSSLSASLGDRVTITC | 403 |
| FRL1-41 | DIQMTQSPSSLSASVGDRVTITC | 405 |
| FRL1-42 | DIQMTQSPSSRSASVGDRVTITC | 403 |
| FRL1-43 | DIQMTQSPSSLSASVGDRVTITC | 406 |
| FRL1-44 | DIQMTQSPSSLSASVGDRVTITC | 403 |
| FRL1-45 | DIQMTQSPSSLSASVGDRVTITC | 403 |
| FRL1-46 | DIQMTQSPSSLSASVGDRVTITC | 403 |
| FRL1-47 | DIQMTQSPSSLSASVGDRVTITC | 403 |
| FRL1-48 | DIQMTQSPSSLSASVGDRVTITC | 403 |
| FRL1-49 | DIQMTQSPSSLSASVGDRVTITC | 403 |
| FRL1-50 | DIQMTQSPSSLSASVGDRVTITC | 403 |
| FRL1-51 | DIQMTQSPSSLSASVGDRVTITC | 403 |
| FRL1-52 | DIQMTQSPSSLSASVGDRVTITC | 403 |
| FRL1-53 | DIQMTQSPSSLSASVGDRVTITC | 403 |
| FRL1-54 | DIQMTQSPSSLSASVGDRVTITC | 403 |
| FRL1-55 | DIQMTQSPSSLSASVGDRVTITC | 403 |
| FRL1-56 | DIQMTQSPSSLSASVGDRVTITC | 407 |
| FRL1-57 | DIQMTQSPSSLSASVGDRVTITC | 403 |
| FRL1-58 | DIQMTQSPSSLSASVGDRVAITC | 403 |
| FRL1-59 | DIQMTQSPSSLSASVGDRVAITC | 403 |
| FRL1-60 | DIQMTQSPSSLSASVGDRVTITC | 403 |
| FRL1-61 | DIQMTQSPSSLSASVGDRVTITC | 403 |
| FRL1-62 | DIQMTQSPSSLSASVGDGVTITC | 403 |
| FRL1-63 | DIQMTQSPSSLSASVGDRVTITC | 408 |
| FRL1-64 | DIQMTQSPSSLSASVGDRVTITC | 403 |
| FRL1-65 | DIQMTQSPSSLSASVGDRVTITC | 403 |
| FRL2-1 | WFQQRPGQSPRRLIY | 408 |
| FRL2-2 | WFQQRPGQSPRRLIY | 408 |
| FRL2-3 | WLQQRPGQSPRRLIY | 409 |
| FRL2-4 | WLQQRPGQSPRRLIY | 409 |
| FRL2-5 | WYLQKPGQPPQLLIY | 410 |
| FRL2-6 | WYLQKPGQPPQLLIY | 410 |

FIGURE 8B

| NAME | SEQUENCE | SEQ ID NO: |
|---|---|---|
| FRL2-7 | WYLQKPGQPPQLLIY | 410 |
| FRL2-8 | WFLQKPGQPPQPLIY | 411 |
| FRL2-9 | WFLQKPGQPPQPLIY | 411 |
| FRL2-11 | WYQQKPGKVPKLLIY | 412 |
| FRL2-12 | WYQQKPGKVPKLLIY | 412 |
| FRL2-13 | WLQQRPGQPPRLLIY | 413 |
| FRL2-14 | WLQQRPGQPPRLLIY | 413 |
| FRL2-15 | WLQQRPGQPPRLLIY | 413 |
| FRL2-16 | WYQQKPGQAPRLLIS | 414 |
| FRL2-17 | WYQQKPGQAPRLLIY | 415 |
| FRL2-18 | WYQQKPGKAPKRLIY | 416 |
| FRL2-19 | WYQQKPGQPPKLFIY | 417 |
| FRL2-20 | WYQQKPGQPPKLFIY | 417 |
| FRL2-21 | WYQQKPGQPPKLLIY | 418 |
| FRL2-22 | WYQQKPGQPPKLLIY | 418 |
| FRL2-23 | WYQQKPGQPPKLLIY | 418 |
| FRL2-24 | WYQQKPGQPPKLLIY | 418 |
| FRL2-25 | WYQQKPGQPPKLLIY | 418 |
| FRL2-26 | WYQQKPGQPPKLLIY | 418 |
| FRL2-27 | WYQQKPGQPPKLLIY | 418 |
| FRL2-28 | WYQQKPGQPPKVLIY | 419 |
| FRL2-29 | WYQQKPGQPPKVLIY | 419 |
| FRL2-30 | WYQQKPGQPPKLLIY | 418 |
| FRL2-31 | WYQQKPGQPPKLLIY | 418 |
| FRL2-32 | WYQQKPGQPPKLLIY | 418 |
| FRL2-33 | WYQQKPGQPPKLLIY | 418 |
| FRL2-34 | WFQQKPGKAPKSLIY | 420 |
| FRL2-35 | WLQQKPGKAPKSLIY | 421 |
| FRL2-36 | WYQQDPGQAPRLLIY | 422 |
| FRL2-37 | WYQQDPGQAPRLLIY | 422 |
| FRL2-38 | WYQQKPGKAPKLLIY | 423 |
| FRL2-39 | WYQQKPGKAPKFLIY | 424 |
| FRL2-40 | WYQQKPGKAPKLLIY | 423 |
| FRL2-41 | WYQQRPGNAPKLLIY | 425 |
| FRL2-42 | WYQQKPGKAPKLLIY | 423 |
| FRL2-43 | WYQQKPGKAPKVLIY | 426 |

FIGURE 8C

| NAME | SEQUENCE | SEQ ID NO: |
|---|---|---|
| FRL2-44 | WYQQKPGKAPKLLIY | 423 |
| FRL2-45 | WYQQKPGKAPKLLIY | 423 |
| FRL2-46 | WYQQKPGKAPKLLIY | 423 |
| FRL2-47 | WYQQKPGKAPKLLIY | 423 |
| FRL2-48 | WYQQKPGKAPKLLIY | 423 |
| FRL2-49 | WYQQKPGKAPKLLIY | 423 |
| FRL2-50 | WYQQKPGKAPKLLIY | 423 |
| FRL2-51 | WYQQKPGKAPKLLIY | 423 |
| FRL2-52 | WYQQKPGKAPKLLIY | 423 |
| FRL2-53 | WYQQKPGKAPKLLIY | 423 |
| FRL2-54 | WYQQKPGKAPKLLIY | 423 |
| FRL2-55 | WYQQKPGKAPKLLIY | 423 |
| FRL2-56 | WYQQKPGKAPELLIY | 427 |
| FRL2-57 | WYQQKPGKAPKLLIY | 423 |
| FRL2-58 | WYQQKPGKAPKLLIY | 423 |
| FRL2-59 | WYQQKPGKAPKLLIY | 423 |
| FRL2-60 | WYQQKPGKAPKLLIY | 423 |
| FRL2-61 | WYQQKPGKAPKLLIY | 423 |
| FRL2-62 | WYQQKPGKAPKLLIY | 423 |
| FRL2-63 | WYQQKLGKAPKLLIH | 428 |
| FRL2-64 | WYQQKPGKAPKLLIY | 423 |
| FRL2-65 | WYQQKPGKAPKLLIY | 423 |
| FRL3-1 | GVPDRFNGSGSGTDFTLKISRVEAEDVGVYYC | 429 |
| FRL3-2 | GVPDRFSGSGSGTDFTLKISRVEAEDVGVYYC | 430 |
| FRL3-3 | GVPDRFSGSGSGTDFTLKISRVEAEDVGVYYC | 430 |
| FRL3-4 | GVPDRFSGSGSGTDFTLKISRVEAEDVGVYYC | 430 |
| FRL3-5 | GVPDRFSGSGSGTDFTLKISRVEAEDVGVYYC | 430 |
| FRL3-6 | GVPDRFSGSGSGTDFTLKISRVEAEDVGVYYC | 430 |
| FRL3-7 | GVPDRFSGSGSGTDFTLKISRVEAEDVGVYYC | 430 |
| FRL3-8 | GVPDRFSGSGSGTDFTLKISRVEAEDVGVYYC | 430 |
| FRL3-9 | GVPDRFSGSGSGTDFTLKISRVEAEDVGVYYC | 430 |
| FRL3-11 | GVPSRFSGSGSGTDFTLTISSLQPEDVATYYC | 431 |
| FRL3-12 | GVPSRFSGSGSGTDFTLTISSLQPEDVATYYC | 431 |
| FRL3-13 | GVPDRFSGSGAGTDFTLKISRVEAEDVGVYYC | 432 |
| FRL3-14 | GVPDRFSGSGAGTDFTLKISRVEAEDVGVYYC | 432 |

FIGURE 8D

| NAME | SEQUENCE | SEQ ID NO: |
|---|---|---|
| FRL3-15 | GVPDRFSGTGAGTDFTLKISRVEAEDVGVYYC | 433 |
| FRL3-16 | GIPDRFSGSGSGTDFTLTISRLEPEDFAVYYC | 434 |
| FRL3-17 | GIPDRFSGSGSGTDFTLTISRLEPEDFAVYYC | 434 |
| FRL3-18 | GVPSRFSGSGSGTEFTLTISSLQPEDFATYYC | 435 |
| FRL3-19 | GVPDRFTGSGSGTDFTLTISSLQAEDVAVYYC | 436 |
| FRL3-20 | GVPDRFTGSGSGTDFTLTISSLQAEDVAVYYC | 436 |
| FRL3-21 | GVPDRFSGSGSGTDFTLTISSLQAEDVAVYYC | 437 |
| FRL3-22 | GVPDRFSGSGSGTDFTLTISSLQAEDVAVYFC | 438 |
| FRL3-23 | GVPDRFSGSGSGTDFTLTISSLQAEDVAVYFC | 438 |
| FRL3-24 | GVPDRFGGSGSGTDFTLTISSLQAEDVAVYYC | 439 |
| FRL3-25 | GVPDRFGGSGSGTDFTLTISSLQAEDVAVYYC | 439 |
| FRL3-26 | GVPDRFSGSGSGTDFTLTISSLQADDVAVYYC | 440 |
| FRL3-27 | GVPDRFSGSGSGTDFTLTISSLQADDVAVYYC | 440 |
| FRL3-28 | GVPDRFSGSGSGTDFTLTISGLQAEDVALYYC | 441 |
| FRL3-29 | GVPDRFSGSGSGTDFTLTISGLQAEDVALYYC | 441 |
| FRL3-30 | GVPDRFSGSGSGTDFTLTISSLQAEDVAVFYC | 442 |
| FRL3-31 | GVPDRFSGSGSGTDFTLTISSLQAEDVAVFYC | 442 |
| FRL3-32 | GVPDRFSGSGSGTDFTLTISSLQAEDVAVYFC | 438 |
| FRL3-33 | GVPDRFSGSGSGTDFTLTISSLQAEDVAVYFC | 438 |
| FRL3-34 | GVPSKFSGSGSGTDFTLTISSLQPEDFATYYC | 443 |
| FRL3-35 | GVPSRFSGSGSGTDFTLTISSLQPEDFATYYC | 444 |
| FRL3-36 | GIPARFSGSGSGTEFTLTISSLQSEDFAVYYC | 445 |
| FRL3-37 | GIPARFSGSGSGTEFTLTISSLQSEDFAVYYC | 445 |
| FRL3-38 | GVPSRFSGSGSGTDFTLTISSLQPEDFATYYC | 444 |
| FRL3-39 | GVPSRFSGSGSGTDFTLTISSLQPEDFAAYYC | 446 |
| FRL3-40 | GVPSRFSGSGSGTDFTLTISSLQPEDFATYYC | 444 |
| FRL3-41 | GVPSRVSGSGSGTDFTLTIRSLQPEDFATYYC | 447 |
| FRL3-42 | GVPSRFSGSGSGTDFTLTLSSLQPEDFATYYC | 448 |
| FRL3-43 | GVPSRFSGSGSGTDFTLTISSLQPEDFATYYC | 444 |
| FRL3-44 | GVPSRFSGSGSGTDFTLTISSLQPENFATYYC | 449 |
| FRL3-45 | GVPSRFSGSGSGTDFTLTFSSLQPEDFATYYC | 450 |
| FRL3-46 | GVPSRFSGSGSGTDFTLTLSSLQPEDFASYYC | 451 |
| FRL3-47 | GVPSRFSGSGSGTDFTLTLSSLQPEDFASYYC | 451 |
| FRL3-48 | GVPSRFSGSGSGTDFTLTISSLQPEDFATYYC | 444 |
| FRL3-49 | GVPSRFSGSGSGTDFTLTISSLQPEDFATYYC | 444 |
| FRL3-50 | GVPSRFSGSGSGTDFTLTISSLQPEDFATYYC | 444 |

FIGURE 8E

| NAME | SEQUENCE | SEQ ID NO: |
|---|---|---|
| FRL3-51 | GVPSRFSGSGSGTDFTLTISSLQPEDFASYYC | 452 |
| FRL3-52 | GVPSRFSGSGSGTDFTLTISSLQPEDFASYYC | 452 |
| FRL3-53 | GVPSRFSGSGSGTDFTLTISSLQPEDFATYYC | 444 |
| FRL3-54 | GVPSRFSGSGSGTDFTFTISSLQPEDIATYYC | 453 |
| FRL3-55 | GVPSRFSGSGSGTDFTFTISSLQPEDIATYYC | 453 |
| FRL3-56 | GVPSRFSGSGSGTDFTFTISSLQPEDIATYYC | 453 |
| FRL3-57 | GVPSRFSGSGSGTDFTFTISSLQPEDIATYYC | 453 |
| FRL3-58 | GVPSRFSGSGSGTDFTFTISSLQPEDIATYYC | 453 |
| FRL3-59 | GVPSRFSGSGSGTDFTFTISSLQPEDIATYYC | 453 |
| FRL3-60 | GVPSRFSGSGSETDFTFTISSLQPEDIATYYC | 454 |
| FRL3-61 | GVPSRFSGSGSGTDFTFTISSLQPEDIATYYC | 453 |
| FRL3-62 | GVPSRFSGSGSGTDFTFTISSLQPEDIATYYC | 453 |
| FRL3-63 | GVPSRFSGSGSGTDFTFTISSLQPEDIATYYC | 453 |
| FRL3-64 | GVPSRFSGSGSGTDFTFTISSLQPEDIATYYC | 453 |
| FRL3-65 | GVPSRFSGSGSGTDFTFTISSLQPEDIATYYC | 453 |
| FRL4-1 | FGQGTRLEIK | 455 |
| FRL4-2 | FGQGTRLEIK | 455 |
| FRL4-3 | FGQGTRLEIK | 455 |
| FRL4-4 | FGQGTRLEIK | 455 |
| FRL4-5 | FGQGTKLEIK | 457 |
| FRL4-6 | FGGGTKVEIK | 458 |
| FRL4-7 | FGGGTKVEIK | 458 |
| FRL4-8 | FGHGTRLEIK | 459 |
| FRL4-9 | FGHGTRLEIK | 459 |
| FRL4-11 | FGPGTKVDIK | 460 |
| FRL4-12 | FGGGTKVEIK | 458 |
| FRL4-13 | FGPGTKVDIK | 460 |
| FRL4-14 | FGPGTKVDIK | 460 |
| FRL4-15 | FGGGTKVEIK | 458 |
| FRL4-16 | FGQGTKVEIK | 461 |
| FRL4-17 | FGQGTKLEIK | 457 |
| FRL4-18 | FGQGTKVEIK | 461 |
| FRL4-19 | FGQGTKVEIK | 461 |
| FRL4-20 | FGQGTKVEIK | 461 |
| FRL4-21 | FGQGTKVEIK | 461 |
| FRL4-22 | FGQGTKVEIK | 461 |

FIGURE 8F

| NAME | SEQUENCE | SEQ ID NO: |
|---|---|---|
| FRL4-23 | FGQGTKVEIK | 461 |
| FRL4-24 | FGQGTKVEIK | 461 |
| FRL4-25 | FGQGTKVEIK | 461 |
| FRL4-26 | FGPGTKVEIK | 462 |
| FRL4-27 | FGPGTKVEIK | 462 |
| FRL4-28 | FGQGTKLEIK | 457 |
| FRL4-29 | FGQGTKLEIK | 457 |
| FRL4-30 | FGGGTKVAIK | 463 |
| FRL4-31 | FGGGTKVAIK | 463 |
| FRL4-32 | FGGGTKVEIK | 458 |
| FRL4-33 | FGGGTKVEIK | 458 |
| FRL4-34 | FGPGTKVDIK | 460 |
| FRL4-35 | FGPGTKMDIK | 464 |
| FRL4-36 | FGQGTKVEIK | 461 |
| FRL4-37 | FGQGTKVEIK | 461 |
| FRL4-38 | FGQGTKVEFK | 465 |
| FRL4-39 | FGPGTKVDIK | 460 |
| FRL4-40 | FGGGTKVEIK | 458 |
| FRL4-41 | FGGGTKVEIK | 458 |
| FRL4-42 | FGQGTRLEIK | 455 |
| FRL4-43 | FGQGTRLEII | 456 |
| FRL4-44 | FGQGTRLEIK | 455 |
| FRL4-45 | FGQGTRLEIK | 455 |
| FRL4-46 | FGQGTRLEIK | 455 |
| FRL4-47 | FGQGTRLEIK | 455 |
| FRL4-48 | FGQGTRLEIK | 455 |
| FRL4-49 | FGQGTRLEIK | 455 |
| FRL4-50 | FGQGTRLEIK | 455 |
| FRL4-51 | FGQGTRLEIK | 455 |
| FRL4-52 | FGQGTRLEIK | 455 |
| FRL4-53 | FGQGTRLEIK | 455 |
| FRL4-54 | FGPGTKVDIK | 460 |
| FRL4-55 | FGPGTKVDIK | 460 |
| FRL4-56 | FGGGTKVEIK | 458 |
| FRL4-57 | FGGGTKVEIK | 458 |
| FRL4-58 | FGGGTKVEIK | 458 |

FIGURE 8G

| NAME | SEQUENCE | SEQ ID NO: |
|---|---|---|
| FRL4-59 | FGGGTKVEIK | 458 |
| FRL4-60 | FGGGTKVEIK | 458 |
| FRL4-61 | FGGGTKVEIR | 466 |
| FRL4-62 | FGQGTRLEIK | 455 |
| FRL4-63 | FGQGTRLEIK | 455 |
| FRL4-64 | FGQGTRLEIK | 455 |
| FRL4-65 | FGQGTRLEIK | 455 |

FIGURE 8H

HEAVY CHAIN FRS

| NAME | NAME | SEQUENCE | SEQ ID NO: |
|---|---|---|---|
| FRH1-1 | FRH1-10.1 | QVQLVQSGAEVKKPGASVKVSCKAS | 467 |
| FRH1-2 | FRH1-10 | QVQLVQSGAEVKKPGASVKVSCKAS | 467 |
| FRH1-3 | FRH1-42 | QVHLVQSGAEVKKPGASVKVSCKVS | 468 |
| FRH1-4 | FRH1-40 | QVQLVQSGAEVKKPGASVKVSCKAS | 467 |
| FRH1-5 | FRH1-30 | QVQLVQSGAEVRKPGASVKVSCKVS | 469 |
| FRH1-6 | FRH1-31 | QVQLVQSGAEVRKPGASVKVSCKVS | 469 |
| FRH1-7 | FRH1-29 | QVTLKESGPVLVKPTETLTLTCTVS | 470 |
| FRH1-8 | FRH1-20 | QVTLKESGPVLVKPTETLTLTCTVS | 470 |
| FRH1-9 | FRH1-65 | QITLKESGPTLVKPTQTLTLTCTFS | 471 |
| FRH1-10 | FRH1-56 | QITLKESGPTLVKPTQTLTLTCTFS | 471 |
| FRH1-11 | FRH1-62 | QITLKESGPTLVKPTQTLTLTCTFS | 471 |
| FRH1-12 | FRH1-2 | QITLKESGPTLVKPTQTLTLTCTFS | 471 |
| FRH1-13 | FRH1-59 | QITLKESGPTLVKPTQTLTLTCTFS | 471 |
| FRH1-14 | FRH1-57 | QITLKESGPTLVKPTQTLTLTCTFS | 471 |
| FRH1-15 | FRH1-64 | QITLKESGPTLVKPTQTLTLTCTFS | 471 |
| FRH1-16 | FRH1-41 | EVQLVESGGGLVKPGGSLRLSCAAS | 472 |
| FRH1-17 | FRH1-45 | EVQLLESGGGLVQPGGSLRLSCAAS | 473 |
| FRH1-18 | FRH1-47 | EVQLLESGGGLVQPGGSLRLSCAAS | 473 |
| FRH1-19 | FRH1-51 | EVQLLESGGGLVQPGGSLRLSCTAS | 474 |
| FRH1-20 | FRH1-52 | EVQLLESGGGLVQPGGSLRLSCTAS | 474 |
| FRH1-21 | FRH1-13 | QVQLVESGGGVVQPGRSLRLSCAAS | 475 |
| FRH1-22 | FRH1-14 | QVQLVESGGGVVQPGRSLRLSCAAS | 475 |
| FRH1-23 | FRH1-1 | QVQLVESGGGVVQPGRSLRLSCAAS | 475 |
| FRH1-24 | FRH1-22 | QVQLVESGGGVVQPGRSLRLSCAAS | 475 |
| FRH1-25 | FRH1-23 | QVQLVESGGGVVQPGRSLRLSCAAS | 475 |
| FRH1-26 | FRH1-12 | QVQLVESGGGVVQPGRSLRLSCAAS | 475 |
| FRH1-27 | FRH1-5 | QVQLVESGGGVVQPGRSLRLSCAAS | 475 |
| FRH1-28 | FRH1-15 | QVQLVESGGGVVQPGRSLRLSCAAS | 475 |
| FRH1-29 | FRH1-7 | QVQLVESGGGVVQPGRSLRLSCAAS | 475 |
| FRH1-30 | FRH1-61 | QVQLVESGGGVVQPGRSLRLSCAAS | 475 |
| FRH1-31 | FRH1-39 | EVQLVESGGGLVQPGGSLRLSCAAS | 476 |
| FRH1-32 | FRH1-34 | EVQLVESGGGLVQPGGSLRLSCAAS | 476 |
| FRH1-33 | FRH1-6 | EVQLVESGGGLVQPGGSLRLSCAAS | 476 |
| FRH1-34 | FRH1-35 | EVQLVESGGGLVQPGGSLRLSCAAS | 476 |
| FRH1-35 | FRH1-21 | QVQLQESGPGLVKPSQTLSLTCTVS | 477 |
| FRH1-36 | FRH1-8 | QVQLQESGPGLVKPSQTLSLTCTVS | 477 |
| FRH1-37 | FRH1-9 | QVQLQESGPGLVKPSQTLSLTCTVS | 477 |

FIGURE 9A

| NAME | NAME | SEQUENCE | SEQ ID NO: |
|---|---|---|---|
| FRH1-38 | FRH1-18 | QVQLQESGPGLVKPSQTLSLTCTVS | 477 |
| FRH1-39 | FRH1-24 | QVQLQESGPGLVKPSQTLSLNCTVS | 478 |
| FRH1-40 | FRH1-25 | QVQLQESGPGLVKPSQTLSLNCTVS | 478 |
| FRH1-41 | FRH1-26 | QVQLQESGPGLVKPSQTLSLTCTVS | 477 |
| FRH1-42 | FRH1-27 | QVQLQESGPGLVKPSQTLSLTCTVS | 477 |
| FRH1-43 | FRH1-38 | QVQLQESGPGLVKPSQTLSLTCTVS | 477 |
| FRH1-44 | FRH1-54 | QVQLQESGPGLVKPSQTLSLTCTVS | 477 |
| FRH1-45 | FRH1-55 | QVQLQESGPGLVKPSQTLSLTCTVS | 477 |
| FRH1-46 | FRH1-43 | QVQLQQWGAGLLKPSETLSLTCAVY | 479 |
| FRH1-47 | FRH1-44 | QVQLQQWGAGLLKPSETLSLTCAVY | 479 |
| FRH1-48 | FRH1-49 | QVQLQQWGAGLLKPSETLSLTCAVY | 479 |
| FRH1-49 | FRH1-50 | QVQLQQWGAGLLKPSETLSLTCAVY | 479 |
| FRH1-50 | FRH1-53 | QVQLQQWGAGLLKPSETLSLTCAVY | 479 |
| FRH1-51 | FRH1-33 | QVQLQESGPGLVKPSETLSLTCTVS | 480 |
| FRH1-52 | FRH1-3 | QVQLQESGPGLVKPSETLSLTCTVS | 480 |
| FRH1-53 | FRH1-4 | QVQLQESGPGLVKPSETLSLTCTVS | 480 |
| FRH1-54 | FRH1-16 | EVQLVQSGAELKKPGESLKISCKGS | 481 |
| FRH1-55 | FRH1-17 | EVQLVQSGAEVKKPGESLKISCKGS | 482 |
| FRH1-56 | FRH1-11 | EVQLVQSGAEVKKPGESLKISCKGS | 482 |
| FRH1-57 | FRH1-37 | QVQLQQSGPGLVKPSQTLSLTCAIS | 483 |
| FRH1-58 | FRH1-39.1 | EVQLVESGGGLVQPGGSLRLSCAAS | 476 |
| FRH2-1 | FRH2-10.1 | WVRQAPGQGLEWMG | 484 |
| FRH2-2 | FRH2-10 | WVRQAPGQGLEWMG | 484 |
| FRH2-3 | FRH2-42 | WVRQAPGQGLEWMG | 484 |
| FRH2-4 | FRH2-40 | WVRQAPGQGLEWMG | 484 |
| FRH2-5 | FRH2-30 | WVRQAPGKGLEWMG | 485 |
| FRH2-6 | FRH2-31 | WVRQAPGKGLEWMG | 485 |
| FRH2-7 | FRH2-29 | WIRQPPGKALEWLA | 486 |
| FRH2-8 | FRH2-20 | WIRQPPGKALEWLV | 487 |
| FRH2-9 | FRH2-65 | WIRQPPGKALEWLA | 486 |
| FRH2-10 | FRH2-56 | WIRQPPGKALEWLA | 486 |
| FRH2-11 | FRH2-62 | WIRQPPGKALEWLA | 486 |
| FRH2-12 | FRH2-2 | WIRQPPGKALEWLA | 486 |
| FRH2-13 | FRH2-59 | WIRQPPGKALEWLA | 486 |
| FRH2-14 | FRH2-57 | WIRQPPGKALEWLA | 486 |
| FRH2-15 | FRH2-64 | WIRQPPGKALEWLA | 486 |
| FRH2-16 | FRH2-41 | WVRQAPGKGLEWVS | 488 |
| FRH2-17 | FRH2-45 | WVRQAPGKGLEWVS | 488 |
| FRH2-18 | FRH2-47 | WVRQAPGKGLEWVS | 488 |
| FRH2-19 | FRH2-51 | WVRQAPGKGLEWVS | 488 |

FIGURE 9B

| NAME | NAME | SEQUENCE | SEQ ID NO: |
|---|---|---|---|
| FRH2-20 | FRH2-52 | WVRQAPGKGLEWVS | 488 |
| FRH2-21 | FRH2-13 | WVRQAPGKGLEWVA | 489 |
| FRH2-22 | FRH2-14 | WVRQAPGKGLEWVA | 489 |
| FRH2-23 | FRH2-1 | WVRQAPGKGLEWVA | 489 |
| FRH2-24 | FRH2-22 | WVRQAPGKGLEWVA | 489 |
| FRH2-25 | FRH2-23 | WVRQAPGKGLEWVA | 489 |
| FRH2-26 | FRH2-12 | WVRQAPGKGLEWVA | 489 |
| FRH2-27 | FRH2-5 | WVRQAPGKGLEWVA | 489 |
| FRH2-28 | FRH2-15 | WVRQAPGKGLEWVA | 489 |
| FRH2-29 | FRH2-7 | WVRQAPGKGLEWVA | 489 |
| FRH2-30 | FRH2-61 | WVRQAPGKGLEWVA | 489 |
| FRH2-31 | FRH2-39 | WVRQAPGKGLEWVS | 488 |
| FRH2-32 | FRH2-34 | WVRQAPGKGLEWVS | 488 |
| FRH2-33 | FRH2-6 | WVRQAPGKGLEWVS | 488 |
| FRH2-34 | FRH2-35 | WVRQAPGKGLEWVS | 488 |
| FRH2-35 | FRH2-21 | WIRQHPGKGLEWIG | 490 |
| FRH2-36 | FRH2-8 | WIRQHPGKGLEWIG | 490 |
| FRH2-37 | FRH2-9 | WIRQHPGKGLEWIG | 490 |
| FRH2-38 | FRH2-18 | WIRQHPGKGLEWIG | 490 |
| FRH2-39 | FRH2-24 | WIRQHPGKGLEWIG | 490 |
| FRH2-40 | FRH2-25 | WIRQHPGKGLEWIG | 490 |
| FRH2-41 | FRH2-26 | WIRQHPGKGLEWIG | 490 |
| FRH2-42 | FRH2-27 | WIRQHPGKGLEWIG | 490 |
| FRH2-43 | FRH2-38 | WIRQHPGKGLEWIG | 490 |
| FRH2-44 | FRH2-54 | WVRQHPGKGLEWIG | 491 |
| FRH2-45 | FRH2-55 | WVRQHPGKGLEWIG | 491 |
| FRH2-46 | FRH2-43 | WIRQPPGKGLEWIG | 492 |
| FRH2-47 | FRH2-44 | WIRQPPGKGLEWIG | 492 |
| FRH2-48 | FRH2-49 | WIRQPPGKGLEWIG | 492 |
| FRH2-49 | FRH2-50 | WIRQPPGKGLEWIG | 492 |
| FRH2-50 | FRH2-53 | WIRQPPGKGLEWIG | 492 |
| FRH2-51 | FRH2-33 | WIRQPAGKGLEWIG | 493 |
| FRH2-52 | FRH2-3 | WIRQPPGKGLEWIG | 492 |
| FRH2-53 | FRH2-4 | WIRQPPGKGLEWIG | 492 |
| FRH2-54 | FRH2-16 | WVRQMPGKGLEWMG | 494 |
| FRH2-55 | FRH2-17 | WVRQMPGKGLEWMG | 494 |
| FRH2-56 | FRH2-11 | WVRQMPGKGLEWMG | 494 |
| FRH2-57 | FRH2-37 | WIRQSPSRGLEWLG | 495 |
| FRH2-58 | FRH2-39.1 | WVRQAPGKGLEWVS | 488 |
| FRH3-1 | FRH3-10.1 | RVTMTTDTSTSTAYMELRSLRSDDTAVYYCAR | 496 |

FIGURE 9C

| NAME | NAME | SEQUENCE | SEQ ID NO: |
|---|---|---|---|
| FRH3-2 | FRH3-10 | RVTMTTDTSTSTAYMELRSLRSDDTAVYYCAR | 496 |
| FRH3-3 | FRH3-42 | RVTMTRDTSISTAYMELSRLRSDDTAVYYCAR | 497 |
| FRH3-4 | FRH3-40 | RVTMTRDTSISTAYMELSRLRSDDTAVYYCAR | 497 |
| FRH3-5 | FRH3-30 | RVTMLEDTSTDTAYMELSSLRSEDTAVYYCAT | 498 |
| FRH3-6 | FRH3-31 | RVTMLEDTSTDTAYMELSSLRSEDTAVYYCAT | 498 |
| FRH3-7 | FRH3-29 | RLTISKDTSKSQVVLTMTNMDPVDTATYYCAR | 499 |
| FRH3-8 | FRH3-20 | RLTISKDTSKSQVVLTMTNMDPVDTATYYCAR | 499 |
| FRH3-9 | FRH3-65 | RLTITKDTSKNQVVLTMTNMDPVDTATYYCAH | 500 |
| FRH3-10 | FRH3-56 | RLTITKDTSKTQVVLTVTDMDPVDTATYYCAH | 501 |
| FRH3-11 | FRH3-62 | RLTITKDTSKNQVVLTMTNMDPVDTATYYCAH | 500 |
| FRH3-12 | FRH3-2 | RLTITKDTSKNQVVLTMTNLDPVDTATYYCAH | 502 |
| FRH3-13 | FRH3-59 | RLTITKATSKNQVVLTMTNMDPVDTATYYCAH | 503 |
| FRH3-14 | FRH3-57 | RLTITKDTSKNQVVLTMTNMDPVDTATYYCAH | 500 |
| FRH3-15 | FRH3-64 | RLTITKDTSKNQVVLTMTNMDPVDTATYYCAH | 500 |
| FRH3-16 | FRH3-41 | RFTISRDNAKNSLYLQMNSLRAEDTAVYYCAR | 504 |
| FRH3-17 | FRH3-45 | RFTISRDNSKNTLYLQMNSLRAEDTAVYYCAK | 505 |
| FRH3-18 | FRH3-47 | RFTISRDNSKNTLYLQMNSLRAEDTAVYYCAK | 505 |
| FRH3-19 | FRH3-51 | RFTISRDNSKNTLYLQMNSLRAEDTAEYYCAK | 506 |
| FRH3-20 | FRH3-52 | RFTISRDNSKNTLYLQMNSLRAEDTAEYYCAK | 506 |
| FRH3-21 | FRH3-13 | RFTISRDNSMNTLYLQMNSLRAEDTAVYYCAR | 507 |
| FRH3-22 | FRH3-14 | RFTISRDNSMNTLYLQMNSLRAEDTAVYYCAR | 507 |
| FRH3-23 | FRH3-1 | RFTISRDNSKNTLYLQMNSLRAEDTAVYYCAR | 508 |
| FRH3-24 | FRH3-22 | RFTISRDNSKNTLYLQMNSLRAEDTAVYYCAR | 508 |
| FRH3-25 | FRH3-23 | RFTISRDNSKNTLYLQMNSLRAEDTAVYYCAR | 508 |
| FRH3-26 | FRH3-12 | RFTISRDNSKNTLYLQMNSLRAEDTAVYYCVL | 509 |
| FRH3-27 | FRH3-5 | RFTISRDNSKNTLYLQMNSLRAEDTAVYYCAR | 508 |
| FRH3-28 | FRH3-15 | RFTVSRDNSKNTLFLQMNSLRAEDTAVYYCAR | 510 |
| FRH3-29 | FRH3-7 | RFTISRDNSKNTLYLQMNSLRAEDTAVYYCAR | 508 |
| FRH3-30 | FRH3-61 | RFTISRDNSKNTLDLQMNSLRAEDTAVYYCAR | 510 |
| FRH3-31 | FRH3-39 | RFTISRDNAKNSLFLQMNSLRDEDTAVYYCAL | 511 |
| FRH3-32 | FRH3-34 | RFTISRDNAKNSVYLQMNSLRDEDTAVYYCAR | 512 |
| FRH3-33 | FRH3-6 | RFTISRDNAKNSLYLQMNSLRDEDTAVYYCAR | 513 |
| FRH3-34 | FRH3-35 | RFTISRDNAKNSLYLQMNSLRDEDTAVYYCAR | 513 |
| FRH3-35 | FRH3-21 | RVTISVDTSKNQFSLNLSSVTAADTAVYYCAR | 514 |
| FRH3-36 | FRH3-8 | RVNMSVDTSKNQFSLKLSSVTAADTAVYYCAR | 515 |
| FRH3-37 | FRH3-9 | RVNMSVDTSKNQFSLKLSSVTAADTAVYYCAR | 515 |
| FRH3-38 | FRH3-18 | RVTISVDTSKNQFSLKLSSVTAADTAVYYCAR | 516 |
| FRH3-39 | FRH3-24 | RITISADTSKNQFSLKLNSVTAADTAVYYCAR | 517 |
| FRH3-40 | FRH3-25 | RITISADTSKNQFSLKLNSVTAADTAVYYCAR | 517 |
| FRH3-41 | FRH3-26 | RITKSVDTSKNQFSLKLSSVTAADTAVYYCAR | 518 |

FIGURE 9D

| NAME | NAME | SEQUENCE | SEQ ID NO: |
|---|---|---|---|
| FRH3-42 | FRH3-27 | RITKSVDTSKNQFSLKLSSVTAADTAVYYCAR | 518 |
| FRH3-43 | FRH3-38 | RVTISVDTSKNQFSLKLSSVTAADTAVYYCAS | 519 |
| FRH3-44 | FRH3-54 | RVTISVDTSKNQFSLKLFSVTAADTAVYFCAR | 520 |
| FRH3-45 | FRH3-55 | RVTISVDTSKNQFSLKLFSVTAADTAVYFCAR | 520 |
| FRH3-46 | FRH3-43 | RVTISVDTSKNQFSLKLSSVTAADTAVYYCAR | 516 |
| FRH3-47 | FRH3-44 | RVTISVDTSKNQFSLKLSSVTAADTAVYYCAR | 516 |
| FRH3-48 | FRH3-49 | RVTISVDTSKNQFSLKLSSVTAADTAVYYCAR | 516 |
| FRH3-49 | FRH3-50 | RVTISVDTSKNQFSLKLSSVTAADTAVYYCAR | 516 |
| FRH3-50 | FRH3-53 | RVTISVDTSKNQFSLKLSSVTAADTAVYYCAR | 516 |
| FRH3-51 | FRH3-33 | RVTMSVDTSKNQFSLKLSSVTAADTAVYYCAR | 521 |
| FRH3-52 | FRH3-3 | RVTISIVTSRNQFSLKLSSVTAADTAVYYCAR | 522 |
| FRH3-53 | FRH3-4 | RVTISIVTSRNQFSLKLSSVTAADTAVYYCAR | 522 |
| FRH3-54 | FRH3-16 | QVTISADKSISTAYLQWSSLKASDTAMYYCAR | 523 |
| FRH3-55 | FRH3-17 | QVTISADKSINTAYLQWSSLKASDTAMYYCAR | 524 |
| FRH3-56 | FRH3-11 | QVTISADKSISTAYLQWSSLKASDTAMYYCAR | 523 |
| FRH3-57 | FRH3-37 | RITINPDTSKNQFSLQLNSVTPEDTAVYYCAR | 525 |
| FRH3-58 | FRH3-39.1 | RFTISRDNAKNSLFLQMNSLRDEDTAVYYCAL | 511 |
| FRH4-1 | FRH4-10.1 | WGQGTLVTVSS | 526 |
| FRH4-2 | FRH4-10 | WGQGTLVTVSS | 526 |
| FRH4-3 | FRH4-42 | WGQGTLVTVSS | 526 |
| FRH4-4 | FRH4-40 | WGQGTLVTVSS | 526 |
| FRH4-5 | FRH4-30 | WGQGTTVTVSS | 527 |
| FRH4-6 | FRH4-31 | WGQGTTVTVSS | 527 |
| FRH4-7 | FRH4-29 | WGQGTLVTVSS | 526 |
| FRH4-8 | FRH4-20 | WGQGTTVTVSS | 527 |
| FRH4-9 | FRH4-65 | WGQGTLVTVSS | 526 |
| FRH4-10 | FRH4-56 | WGQGTLVTVSS | 526 |
| FRH4-11 | FRH4-62 | WGQGTLVTVSS | 526 |
| FRH4-12 | FRH4-2 | WGQGTLVTVSS | 526 |
| FRH4-13 | FRH4-59 | WGQGTLVTVSS | 526 |
| FRH4-14 | FRH4-57 | WGQGTLVTVSS | 526 |
| FRH4-15 | FRH4-64 | WGQGTLVTVSS | 526 |
| FRH4-16 | FRH4-41 | WGQGTMVTVSS | 528 |
| FRH4-17 | FRH4-45 | WGQGTTVTVSS | 527 |
| FRH4-18 | FRH4-47 | WGQGTTVTVSS | 527 |
| FRH4-19 | FRH4-51 | WGQGTTVTVSS | 527 |
| FRH4-20 | FRH4-52 | WGQGTTVTVSS | 527 |
| FRH4-21 | FRH4-13 | WGQGTLVTVSS | 526 |
| FRH4-22 | FRH4-14 | WGQGTLVTVSS | 526 |
| FRH4-23 | FRH4-1 | WGQGTLVTVSS | 526 |

FIGURE 9E

| NAME | NAME | SEQUENCE | SEQ ID NO: |
|---|---|---|---|
| FRH4-24 | FRH4-22 | WGQGTLVTVSS | 526 |
| FRH4-25 | FRH4-23 | WGQGTLVTVSS | 526 |
| FRH4-26 | FRH4-12 | WGQGSLVTVSP | 529 |
| FRH4-27 | FRH4-5 | WGQGTLVTVSS | 526 |
| FRH4-28 | FRH4-15 | WGQGTTVTVSS | 527 |
| FRH4-29 | FRH4-7 | WGQGTLVTVSS | 526 |
| FRH4-30 | FRH4-61 | WGQGTLVTVSS | 526 |
| FRH4-31 | FRH4-39 | WGQGTLVTVSS | 526 |
| FRH4-32 | FRH4-34 | WGQGTTVTVSS | 527 |
| FRH4-33 | FRH4-6 | WGQGTTVTVSS | 527 |
| FRH4-34 | FRH4-35 | WGQGTTVTVSS | 527 |
| FRH4-35 | FRH4-21 | WGQGTTVTVSS | 527 |
| FRH4-36 | FRH4-8 | WGQGTKVTVSS | 530 |
| FRH4-37 | FRH4-9 | WGQGTKVTVSS | 530 |
| FRH4-38 | FRH4-18 | WGQGTTVTVSS | 527 |
| FRH4-39 | FRH4-24 | WGQGTTVTVSS | 527 |
| FRH4-40 | FRH4-25 | WGQGTTVTVSS | 527 |
| FRH4-41 | FRH4-26 | WGRGTLVTVSS | 531 |
| FRH4-42 | FRH4-27 | WGRGTLVTVSS | 531 |
| FRH4-43 | FRH4-38 | WGQGTTVTVSS | 527 |
| FRH4-44 | FRH4-54 | WGQGTLVTVSS | 526 |
| FRH4-45 | FRH4-55 | WGQGTLVTVSS | 526 |
| FRH4-46 | FRH4-43 | WGQGTLVTVSS | 526 |
| FRH4-47 | FRH4-44 | WGQGTLVTVSS | 526 |
| FRH4-48 | FRH4-49 | WGQGTLVTVSS | 526 |
| FRH4-49 | FRH4-50 | WGQGTLVTVSS | 526 |
| FRH4-50 | FRH4-53 | WGQGTLVTVSS | 526 |
| FRH4-51 | FRH4-33 | WGQGTTVTVSS | 527 |
| FRH4-52 | FRH4-3 | WGQGTMVTVSS | 528 |
| FRH4-53 | FRH4-4 | WGQGTMVTVSS | 528 |
| FRH4-54 | FRH4-16 | WGQGTLVTVSS | 526 |
| FRH4-55 | FRH4-17 | WGQGTLVTVSS | 526 |
| FRH4-56 | FRH4-11 | WGQGTTVTVSS | 527 |
| FRH4-57 | FRH4-37 | WGQGTTVTVSS | 527 |
| FRH4-58 | FRH4-39.1 | WGQGTLVTVSS | 526 |

FIGURE 9F

FIGURE 10A: Light Chain Variable Regions

```
             1               20                    40                    60                    80
U2-1    DVVMTQSPLS LPVTLGQPAS ISCRSSQSLV YSDGN.TYLN WFQQRPGQSP RRLIYKVSNW DSGVPDRFNG SGSGTDFTLK
U2-2    DVVMTQSPLS LPVTLGQPAS ISCRSSQSLV YSDGN.TYLN WFQQRPGQSP RRLIYKVSNW DSGVPDRFSG SGSGTDFTLK
U2-3    DVVMTQSPLS LPVTLGQPAS ISCRSSQSLV YSDGN.TYLN WLQQRPGQSP RRLIYKVSNW DSGVPDRFSG SGSGTDFTLK
U2-4    DVVMTQSPLS LPVTLGQPAS ISCRSSQSLV YSDGN.TYLN WLQQRPGQSP RRLIYKVSNW DSGVPDRFSG SGSGTDFTLK
U2-5    DIVMTQTPLS LSVTPGQPAS ISCKSSQSLL HSDGK.TYLY WYLQKPGQPP QLLIYEVSNR FSGVPDRFSG SGSGTDFTLK
U2-6    DIVMTQTPLS LSVTPGQPAS ISCKSSQSLL HSDGK.TYLY WYLQKPGQPP QLLIYEVSNR FSGVPDRFSG SGSGTDFTLK
U2-7    DIVMTQTPLS LSVTPGQPAS ISCKSSQSLL HSDGK.TYLY WYLQKPGQPP QLLIYEVSNR FSGVPDRFSG SGSGTDFTLK
U2-8    DIVMTQTPLS LSVTPGQPAS ISCKSSQSLL HSDGK.TYLY WFLQKPGQPP QPLIYEVSNR FSGVPDRFSG SGSGTDFTLK
U2-9    DIVMTQTPLS LSVTPGQPAS ISCKSSQSLL HSDGK.TYLY WFLQKPGQPP QPLIYEVSNR FSGVPDRFSG SGSGTDFTLK
U2-11   DIQMTQSPSS LSASVGDRVT ITCRASQGIA ....N..YLA WYQQKPGKVP KLLIYVASTL QSGVPSRFSG SGSGTDFTLT
U2-12   DIQMTQSPSS LSASVGDRVT IICRASQGIS .ND.....LA WYQQKPGKVP KLLIYAASTL QSGVPSRFSG SGSGTDFTLT
U2-13   NIVMTQTPLS SPVTLGQPAS ISCRSSQSLV HSDGN.TYLS WLQQRPGQPP RLLIYKISNR FSGVPDRFSG SGAGTDFTLK
U2-14   NIVMTQTPLS SPVTLGQPAS ISCRSSQSLV HSDGN.TYLS WLQQRPGQPP RLLIYKISNR FSGVPDRFSG SGAGTDFTLK
U2-15   EIVMTQTPLS SPVTLGQPAS ISCRSSQSLV HSDGN.TYLS WLQQRPGQPP RLLIYKISNR FSGVPDRFSG TGAGTDFTLK
U2-16   EIVLTQSPGT LSLSPGERAT LSCRASQTVI SS.....YLA WYQQKPGQAP RLLISGASSR ATGIPDRFSG SGSGTDFTLT
U2-17   EIVLTQSPGT LSLSPGERAT LSCRASQSVS R......LA WYQQKPGQAP RLLIYGASRR ATGIPDRFSG SGSGTDFTLT
U2-18   DIQMTQSPSS LSASVGDRVT ITCRASQGIR .ND....LG WYQQKPGKAP KRLIYAASSL QSGVPSRFSG SGSGTEFTLT
U2-19   DIVMTQSPDS LAVSLGERAT INCKSSQSVL YSSNNKNYLV WYQQKPGQPP KLFIYWASTR ESGVPDRFTG SGSGTDFTLT
U2-20   DIVMTQSPDS LAVSLGERAT INCKSSQSVL YSSNNKNYLV WYQQKPGQPP KLFIYWASTR ESGVPDRFTG SGSGTDFTLT
U2-21   DIVMTQSPDS LAVSLGERAT INCKSSQSVL YSSNNKNYLA WYQQKPGQPP KLLIYWASTR ESGVPDRFSG SGSGTDFTLT
U2-22   DIVMTQSPDS LAVSLGERAT INCKSSQNVL YSSNNKNYLA WYQQKPGQPP KLLIYWASTR ESGVPDRFSG SGSGTDFTLT
U2-23   DIVMTQSPDS LAVSLGERAT INCKSSQNVL YSSNNKNYLA WYQQKPGQPP KLLIYWASTR ESGVPDRFSG SGSGTDFTLT
U2-24   DIVMTQSPDS LTVSLGERAT INCKSSQSVL YSSNNKNYLA WYQQKPGQPP KLLIYWASTR ESGVPDRFGG SGSGTDFTLT
U2-25   DIVMTQSPDS LTVSLGERAT INCKSSQSVL YSSNNKNYLA WYQQKPGQPP KLLIYWASTR ESGVPDRFGG SGSGTDFTLT
U2-26   DIVMTQSPDS LAVSLGERAT INCKSSQSVL YNSNNKNYLA WYQQKPGQPP KLLIYWASTR ESGVPDRFSG SGSGTDFTLT
U2-27   DIVMTQSPDS LAVSLGERAT INCKSSQSVL YNSNNKNYLA WYQQKPGQPP KLLIYWASTR ESGVPDRFSG SGSGTDFTLT
U2-28   DIVMTQSPDS LAVSLGERAT INCKSSQSVL YSSNNKNYLA WYQQKPGQPP KVLIYWASTR KSGVPDRFSG SGSGTDFTLT
U2-29   DIVMTQSPDS LAVSLGERAT INCKSSQSVL YSSNNKNYLA WYQQKPGQPP KVLIYWASTR KSGVPDRFSG SGSGTDFTLT
U2-30   DIVMTQSPDS LAVSLGERAT INCKSSQSVL DSSNNKNYLA WYQQKPGQPP KLLIYWASTR ESGVPDRFSG SGSGTDFTLT
U2-31   DIVMTQSPDS LAVSLGERAT INCKSSQSVL DSSNNKNYLA WYQQKPGQPP KLLIYWASTR ESGVPDRFSG SGSGTDFTLT
U2-32   DIVMTQSPDS LAVSLGERAT INCKSSQSIL YRSNNKNYLA WYQQKPGQPP KLLIYWASAR ESGVPDRFSG SGSGTDFTLT
U2-33   DIVMTQSPDS LAVSLGERAT INCKSSQSIL YRSNNKNYLA WYQQKPGQPP KLLIYWASAR ESGVPDRFSG SGSGTDFTLT
U2-34   DIQMTQSPSS LSASVGDRVT ITCRASQDIS H......YLA WFQQKPGKAP KSLIYAASSL QSGVPSKFSG SGSGTDFTLT
U2-35   DIQMTQSPSS LSASVGDRVA ITCRASQDIS .....NYLA WLQQKPGKAP KSLIYAASSL QSGVPSRFSG SGSGTDFTLT
U2-36   EIVMTQSPAT LSVSPGERAT LSCRASQSVS ..SN....LA WYQQDPGQAP RLLIYGASRR ATGIPARFSG SGSGTEFTLT
U2-37   EIVMTQSPAT LSVSPGERAT LSCRASQSVS ..SN....LA WYQQDPGQAP RLLIYGASRR ATGIPARFSG SGSGTEFTLT
U2-38   DIQMTQSPSS VSASVGDRVT ITCRASQDIS ..RW....LA WYQQKPGKAP KLLIYAASSL QSGVPSRFSG SGSGTDFTLT
U2-39   DIQMTQSPSS LSASVGDRVT ITCRASQSIS ......TYLN WYQQKPGKAP KFLIYAASSL QSGVPSRFSG SGSGTDFTLT
U2-40   DIQMTQSPSS LSASLGDRVT ITCRASQTIS ......IYLN WYQQKPGKAP KLLIYAASSL QSGVPSRFSG SGSGTDFTLT
U2-41   DIQMTQSPSS LSASVGDRVT ITCRASQSIR ...S....YLN WYQQRPGNAP KLLIYAASSL QSGVPSRVSG SGSGTDFTLT
U2-42   DIQMTQSPSS RSASVGDRVT ITCRASQTIS ......RYLN WYQQKPGKAP KLLIYAASTL QSGVPSRFSG SGSGTDFTLT
U2-43   DIQMTQSPSS LSASVGDRVT ITCRASQRIS ..S....YLN WYQQKPGKAP KVLIYAESSL QSGVPSRFSG SGSGTDFTLT
U2-44   DIQMTQSPSS LSASVGDRVT ITCRASQSIS ......RYLN WYQQKPGKAP KLLIYTASSL QSGVPSRFSG SGSGTDFTLT
U2-45   DIQMTQSPSS LSASVGDRVT ITCRASQSIS ..S....YLN WYQQKPGKAP KLLIYTASSL QSGVPSRFSG SGSGTDFTLT
U2-46   DIQMTQSPSS LSASVGDRVT ITCRASQSIS ..S....YLN WYQQKPGKAP KLLIYTASSL QSGVPSRFSG SGSGTDFTLT
U2-47   DIQMTQSPSS LSASVGDRVT ITCRASQSIS ..S....YLN WYQQKPGKAP KLLIYTASSL QSGVPSRFSG SGSGTDFTLT
U2-48   DIQMTQSPSS LSASVGDRVT ITCRASQSIS ..S....YLN WYQQKPGKAP KLLIYTVSSL QSGVPSRFSG SGSGTDFTLT
U2-49   DIQMTQSPSS LSASVGDRVT ITCRASQSIS ..S....YLN WYQQKPGKAP KLLIYTVSSL QSGVPSRFSG SGSGTDFTLT
U2-50   DIQMTQSPSS LSASVGDRVT ITCRASQSIS ..S....YLN WYQQKPGKAP KLLIYTVSSL QSGVPSRFSG SGSGTDFTLT
U2-51   DIQMTQSPSS LSASVGDRVT ITCRASQSIS ..S....YLN WYQQKPGKAP KLLIYTASSL QSGVPSRFSG SGSGTDFTLT
U2-52   DIQMTQSPSS LSASVGDRVT ITCRASQSIS ..S....YLN WYQQKPGKAP KLLIYTASSL QSGVPSRFSG SGSGTDFTLT
U2-53   DIQMTQSPSS LSASVGDRVT ITCRASQSIS ..S....YLN WYQQKPGKAP KLLIYTASSL QSGVPSRFSG SGSGTDFTLT
U2-54   DIQMTQSPSS LSASVGDRVT ITCQASQDIS ......NYLN WYQQKPGKAP KLLIYDASNL ETGVPSRFSG SGSGTDFTFT
U2-55   DIQMTQSPSS LSASVGDRVT ITCQASQDIS ......NYLN WYQQKPGKAP KLLIYDASNL ETGVPSRFSG SGSGTDFTFT
U2-56   DIQMTQSPSS LSASVGDRVT ITCQASQDIS ......NSLN WYQQKPGKAP ELLIYDASNL ETGVPSRFSG SGSGTDFTFT
U2-57   DIQMTQSPSS LSASVGDRVT ITCQASQDIS ...D...YLN WYQQKPGKAP KLLIYDASNL ETGVPSRFSG SGSGTDFTFT
U2-58   DIQMTQSPSS LSASVGDRVA ITCQASQDIS ......NYLN WYQQKPGKAP KLLIYDASNL ETGVPSRFSG SGSGTDFTFT
U2-59   DIQMTQSPSS LSASVGDRVA ITCQASQDIS ......NYLN WYQQKPGKAP KLLIYDASNL ETGVPSRFSG SGSGTDFTFT
U2-60   DIQMTQSPSS LSASVGDRVT ITCQASQDIS ......NSLN WYQQKPGKAP KLLIYDASIL ETGVPSRFSG SGSETDFTFT
U2-61   DIQMTQSPSS LSASVGDRVT ITCQASQDIS ......NSLN WYQQKPGKAP KLLIYDASNL ETGVPSRFSG SGSGTDFTFT
U2-62   DIQMTQSPSS LSASVGDGVT ITCQASQDIT ......NYLN WYQQKPGKAP KLLIYDASNL ETGVPSRFSG SGSGTDFTFT
U2-63   DIQMTQSPSS LSASVGDRVT ITCQASQDIS ......NYLN WYQQKLGKAP KLLIHDASNL ETGVPSRFSG SGSGTDFTFT
U2-64   DIQMTQSPSS LSASVGDRVT ITCQASQDIS ...D...YLN WYQQKPGKAP KLLIYDASNL ETGVPSRFSG SGSGTDFTFT
U2-65   DIQMTQSPSS LSASVGDRVT ITCQASQDIS ......NSLN WYQQKPGKAP KLLIYDASNL ETGVPSRFSG SGSGTDFTFT
                                       CDR1                              CDR2
```

FIGURE 10B

```
              100           114
U2-1    ISRVEAEDVG VYYC MQSTHW .PIT FGQGTR LEIK  (SEQ ID NO:94)
U2-2    ISRVEAEDVG VYYC IQGTHW .PTT FGQGTR LEIK  (SEQ ID NO:95)
U2-3    ISRVEAEDVG VYYC MQGTHW .PIT FGQGTR LEIK  (SEQ ID NO:96)
U2-4    ISRVEAEDVG VYYC MQGTHW .PIT FGQGTR LEIK  (SEQ ID NO:96)
U2-5    ISRVEAEDVG VYYC MQGIQL .PCS FGQGTK LEIK  (SEQ ID NO:97)
U2-6    ISRVEAEDVG VYYC MQSIQL .PLT FGGGTK VEIK  (SEQ ID NO:98)
U2-7    ISRVEAEDVG VYYC MQSIQL .PLT FGGGTK VEIK  (SEQ ID NO:98)
U2-8    ISRVEAEDVG VYYC MQSIQL .PIT FGHGTR LEIK  (SEQ ID NO:99)
U2-9    ISRVEAEDVG VYYC MQSIQL .PIT FGHGTR LEIK  (SEQ ID NO:99)
U2-11   ISSLQPEDVA TYYC QNYNSA .PFT FGPGTK VDIK  (SEQ ID NO:100)
U2-12   ISSLQPEDVA TYYC QKYNSV .PLT FGGGTK VEIK  (SEQ ID NO:101)
U2-13   ISRVEAEDVG VYYC MQATQF .PHT FGPGTK VDIK  (SEQ ID NO:102)
U2-14   ISRVEAEDVG VYYC MQATQF .PHT FGPGTK VDIK  (SEQ ID NO:102)
U2-15   ISRVEAEDVG VYYC MQATQF .PHT FGGGTK VEIK  (SEQ ID NO:103)
U2-16   ISRLEPEDFA VYYC QQYGSS .PRT FGQGTK VEIK  (SEQ ID NO:104)
U2-17   ISRLEPEDFA VYYC QQYGSS .PRS FGQGTK LEIK  (SEQ ID NO:105)
U2-18   ISSLQPEDFA TYYC LQHNSY .PPT FGQGTK VEIK  (SEQ ID NO:106)
U2-19   ISSLQAEDVA VYYC QQYYSF .PWT FGQGTK VEIK  (SEQ ID NO:107)
U2-20   ISSLQAEDVA VYYC QQYYSF .PWT FGQGTK VEIK  (SEQ ID NO:107)
U2-21   ISSLQAEDVA VYYC QQYYST .TWT FGQGTK VEIK  (SEQ ID NO:108)
U2-22   ISSLQAEDVA VYFC QQYYGT .PRT FGQGTK VEIK  (SEQ ID NO:109)
U2-23   ISSLQAEDVA VYFC QQYYGT .PRT FGQGTK VEIK  (SEQ ID NO:110)
U2-24   ISSLQAEDVA VYYC QQYYSI .SRT FGQGTK VEIK  (SEQ ID NO:111)
U2-25   ISSLQAEDVA VYYC QQYYSI .SRT FGQGTK VEIK  (SEQ ID NO:111)
U2-26   ISSLQADDVA VYYC QQYYST .TWT FGPGTK VEIK  (SEQ ID NO:112)
U2-27   ISSLQADDVA VYYC QQYYST .TWT FGPGTK VEIK  (SEQ ID NO:113)
U2-28   ISGLQAEDVA LYYC QQYYST .MFS FGQGTK LEIK  (SEQ ID NO:114)
U2-29   ISGLQAEDVA LYYC QQYYST .MFS FGQGTK LEIK  (SEQ ID NO:114)
U2-30   ISSLQAEDVA VFYC HQYYST .PLT FGGGTK VAIK  (SEQ ID NO:115)
U2-31   ISSLQAEDVA VFYC HQYYST .PLT FGGGTK VAIK  (SEQ ID NO:115)
U2-32   ISSLQAEDVA VYFC QQYFIT .PLT FGGGTK VEIK  (SEQ ID NO:116)
U2-33   ISSLQAEDVA VYFC QQYFIT .PLT FGGGTK VEIK  (SEQ ID NO:116)
U2-34   ISSLQPEDFA TYYC QQYNNY .PFT FGPGTK VDIK  (SEQ ID NO:117)
U2-35   ISSLQPEDFA TYYC QQYNTY .PFT FGPGTK MDIK  (SEQ ID NO:118)
U2-36   ISSLQSEDFA VYYC QQHNNW PPWT FGQGTK VEIK  (SEQ ID NO:119)
U2-37   ISSLQSEDFA VYYC QQHNNW PPWT FGQGTK VEIK  (SEQ ID NO:119)
U2-38   ISSLQPEDFA TYYC QQANSF .PPT FGQGTK VEFK  (SEQ ID NO:120)
U2-39   ISSLQPEDFA AYYC QQSHSA .PFT FGPGTK VDIK  (SEQ ID NO:121)
U2-40   ISSLQPEDFA TYYC QQSYST ..LT FGGGTK VEIK  (SEQ ID NO:122)
U2-41   IRSLQPEDFA TYYC QQSYSI .PLT FGGGTK VEIK  (SEQ ID NO:123)
U2-42   LSSLQPEDFA TYYC QQIYST .SIT FGQGTR LEIK  (SEQ ID NO:124)
U2-43   ISSLQPEDFA TYYC QQSYIT .PIT FGQGTR LEII  (SEQ ID NO:125)
U2-44   ISSLQPENFA TYYC QQSYFT .PIT FGQGTR LEIK  (SEQ ID NO:126)
U2-45   FSSLQPEDFA TYYC QQSYFS .PIT FGQGTR LEIK  (SEQ ID NO:127)
U2-46   LSSLQPEDFA SYYC QQSFYT .PIT FGQGTR LEIK  (SEQ ID NO:128)
U2-47   LSSLQPEDFA SYYC QQSFYT .PIT FGQGTR LEIK  (SEQ ID NO:128)
U2-48   ISSLQPEDFA TYYC QQSYFT .PIT FGQGTR LEIK  (SEQ ID NO:129)
U2-49   ISSLQPEDFA TYYC QQSYFT .PIT FGQGTR LEIK  (SEQ ID NO:129)
U2-50   ISSLQPEDFA TYYC QQSYFT .PIT FGQGTR LEIK  (SEQ ID NO:129)
U2-51   ISSLQPEDFA SYYC QQSFYA .PIT FGQGTR LEIK  (SEQ ID NO:130)
U2-52   ISSLQPEDFA SYYC QQSFYA .PIT FGQGTR LEIK  (SEQ ID NO:130)
U2-53   ISSLQPEDFA TYYC QQSYFT .PIT FGQGTR LEIK  (SEQ ID NO:131)
U2-54   ISSLQPEDIA TYYC QQYDYL .PFT FGPGTK VDIK  (SEQ ID NO:132)
U2-55   ISSLQPEDIA TYYC QQYDYL .PFT FGPGTK VDIK  (SEQ ID NO:132)
U2-56   ISSLQPEDIA TYYC QQCDDL .PLT FGGGTK VEIK  (SEQ ID NO:133)
U2-57   ISSLQPEDIA TYYC QHYDNL .PLT FGGGTK VEIK  (SEQ ID NO:134)
U2-58   ISSLQPEDIA TYYC QQYDNL .PLT FGGGTK VEIK  (SEQ ID NO:135)
U2-59   ISSLQPEDIA TYYC QQYDNL .PLT FGGGTK VEIK  (SEQ ID NO:135)
U2-60   ISSLQPEDIA TYYC QQCDIL .PLS FGGGTK VEIK  (SEQ ID NO:136)
U2-61   ISSLQPEDIA TYYC QQYDNL .PLA FGGGTK VEIR  (SEQ ID NO:137)
U2-62   ISSLQPEDIA TYYC QQYDSL .PIT FGQGTR LEIK  (SEQ ID NO:138)
U2-63   ISSLQPEDIA TYYC QQYDNL .PIT FGQGTR LEIK  (SEQ ID NO:139)
U2-64   ISSLQPEDIA TYYC QHYDNL .PIT FGQGTR LEIK  (SEQ ID NO:140)
U2-65   ISSLQPEDIA TYYC QHYDNL .PIT FGQGTR LEIK  (SEQ ID NO:141)
                        CDR3
```

FIGURE 11A: Heavy Chain Variable Regions

```
            1                   20                    40                     60
U2-1      QVQLVQSGAE VKKPGASVKV SCKASGYTFT SYGIS..WVR QAPGQGLEWM GWISASNGNT NYAQKLQD.R
U2-2      QVQLVQSGAE VKKPGASVKV SCKASGYTFT SYGIS..WVR QAPGQGLEWM GWISASNGNT NYAQKLQD.R
U2-3      QVHLVQSGAE VKKPGASVKV SCKVSGYTFT GHYMH..WVR QAPGQGLEWM GWINPNSGGT NCAQKFQG.R
U2-4      QVQLVQSGAE VKKPGASVKV SCKASGYTFT GYYMH..WVR QAPGQGLEWM GWINPNSGGT NHTQKFQG.R
U2-5      QVQLVQSGAE VRKPGASVKV SCKVSGYTLT ELSMH..WVR QAPGKGLEWM GSFDPEDGET IYAQKFQG.R
U2-6      QVQLVQSGAE VRKPGASVKV SCKVSGYTLT ELSMH..WVR QAPGKGLEWM GSFDPEDGET IYAQKFQG.R
U2-7      QVTLKESGPV LVKPTETLTL TCTVSGFSLS NARMGVSWIR QPPGKALEWL AHIFSNDEKS YSTSLKS..R
U2-8      QVTLKESGPV LVKPTETLTL TCTVSGFSLS NARMGVSWIR QPPGKALEWL VLIFSNDEKS YSTSLKS..R
U2-9      QITLKESGPT LVKPTQTLTL TCTFSGFSLS TGGVGVGWIR QPPGKALEWL ALIYWNDDKR YSPSLKS..R
U2-10     QITLKESGPT LVKPTQTLTL TCTFSGFSLS TGGVGVGWIR QPPGKALEWL ALIYWNDDKR YSPSLKS..R
U2-11     QITLKESGPT LVKPTQTLTL TCTFSGFSLN TGGVGVGWIR QPPGKALEWL ALIYWNDDKR YSPSLKS..R
U2-12     QITLKESGPT LVKPTQTLTL TCTFSGFSLS TGGVGVGWIR QPPGKALEWL ALIYWNDDKR YSPSLKS..R
U2-13     QITLKESGPT LVKPTQTLTL TCTFSGFSLS TGGVGVGWIR QPPGKALEWL ALIYWNVEKR YSPSLRS..R
U2-14     QITLKESGPT LVKPTQTLTL TCTFSGFSLS TGGVGVGWIR QPPGKALEWL ALIYWNDDKR YSPSLKS..R
U2-15     QITLKESGPT LVKPTQTLTL TCTFSGFSLS TGGVGVGWIR QPPGKALEWL ALIYWNDDKR YSPSLKS..R
U2-16     EVQLVESGGG LVKPGGSLRL SCAASGFPFS RYS   MNWVR QAPGKGLEWV SAISSSSSYI YYADSVKG.R
U2-17     EVQLLESGGG LVQPGGSLRL SCAASGFTFS SYA   MNWVR QAPGKGLEWV SAISGSGGST YYADSVKG.R
U2-18     EVQLLESGGG LVQPGGSLRL SCAASGFTFS SYA   MSWVR QAPGKGLEWV SAISGSGGST YYADSVKG.R
U2-19     EVQLLESGGG LVQPGGSLRL SCTASGFTFS SYA   MSWVR QAPGKGLEWV SAISGSGGST YYADSVKG.R
U2-20     EVQLLESGGG LVQPGGSLRL SCTASGFTFS SYA   MSWVR QAPGKGLEWV SAISGSGGST YYADSVKG.R
U2-21     QVQLVESGGG VVQPGRSLRL SCAASGFTFS SYG   MHWVR QAPGKGLEWV AFISDDGSTK YYADSVKG.R
U2-22     QVQLVESGGG VVQPGRSLRL SCAASGFTFS SYG   MHWVR QAPGKGLEWV AFISDDGSTK YYADSVKG.R
U2-23     QVQLVESGGG VVQPGRSLRL SCAASGFTFS SYG   MHWVR QAPGKGLEWV AVIWYDGSNK YYADSVKG.R
U2-24     QVQLVESGGG VVQPGRSLRL SCAASGFTFS SYD   MHWVR QAPGKGLEWV AVIWYDGSIK YYADSVKG.R
U2-25     QVQLVESGGG VVQPGRSLRL SCAASGFTFS SYD   MHWVR QAPGKGLEWV AVIWYDGSIK YYADSVKG.R
U2-26     QVQLVESGGG VVQPGRSLRL SCAASGFTFS SYG   MHWVR QAPGKGLEWV AVIWYDGSNK YYADSVKG.R
U2-27     QVQLVESGGG VVQPGRSLRL SCAASGFTFS SYG   MHWVR QAPGKGLEWV AVIWSDGSNK YYADSVKG.R
U2-28     QVQLVESGGG VVQPGRSLRL SCAASGFTFS SYG   MHWVR QAPGKGLEWV AVIWDDGSNQ YYTDSVKG.R
U2-29     QVQLVESGGG VVQPGRSLRL SCAASGFTFS SYG   MHWVR QAPGKGLEWV AVIWYDGSNK RYVDSVKG.R
U2-30     QVQLVESGGG VVQPGRSLRL SCAASGFTFR SHG   MHWVR QAPGKGLEWV AVIWYDGSNK NYADSVRG.R
U2-31     EVQLVESGGG LVQPGGSLRL SCAASGFTFS AYS   MNWVR QAPGKGLEWV SYISSSGRTI YYADSVKG.R
U2-32     EVQLVESGGG LVQPGGSLRL SCAASGFTFS SYS   MNWVR QAPGKGLEWV SHISSSSRTI YYADSVKG.R
U2-33     EVQLVESGGG LVQPGGSLRL SCAASGFTFS SYS   MNWVR QAPGKGLEWV SHISRSSRTI YYADSVKG.R
U2-34     EVQLVESGGG LVQPGGSLRL SCAASGFTFS SYS   MNWVR QAPGKGLEWV SHISRSSRTI YYADSVKG.R
U2-35     QVQLQESGPG LVKPSQTLSL TCTVSGGSVS SGGYYWSWIR QHPGKGLEWI GYIHSSGSTY YNPSLKS..R
U2-36     QVQLQESGPG LVKPSQTLSL TCTVSGGSIS RGGYYWSWIR QHPGKGLEWI GYIYHSGSTY YNPSLKS..R
U2-37     QVQLQESGPG LVKPSQTLSL TCTVSGGSIS RGGYYWSWIR QHPGKGLEWI GYIYHSGSTY YNPSLKS..R
U2-38     QVQLQESGPG LVKPSQTLSL TCTVSGGSIS SGGYYWSWIR QHPGKGLEWI GYIYYSGSTY YNPSLKS..R
U2-39     QVQLQESGPG LVKPSQTLSL NCTVSGGSIS SGGYYWSWIR QHPGKGLEWI GYIHYSGSTY YNPSLKS..R
U2-40     QVQLQESGPG LVKPSQTLSL NCTVSGGSIS SGGYYWSWIR QHPGKGLEWI GYIHYSGSTY YNPSLKS..R
U2-41     QVQLQESGPG LVKPSQTLSL TCTVSGGSIS SGGYYWSWIR QHPGKGLEWI GYIHSSGSTY YNPSLKS..R
U2-42     QVQLQESGPG LVKPSQTLSL TCTVSGGSIS SGGYYWSWIR QHPGKGLEWI GYIHSSGSTY YNPSLKS..R
U2-43     QVQLQESGPG LVKPSQTLSL TCTVSGGSIS SGGYYWSWIR QHPGKGLEWI GYIHYSGSTY YNPSLKS..R
U2-44     QVQLQESGPG LVKPSQTLSL TCTVSGGSIS SGDYYWNWVR QHPGKGLEWI GYIYYSGGTY YNPSLKS..R
U2-45     QVQLQESGPG LVKPSQTLSL TCTVSGGSIS SGDYYWNWVR QHPGKGLEWI GYIYYSGGTY YNPSLKS..R
U2-46     QVQLQQWGAG LLKPSETLSL TCAVYGGSFS ..GYYWSWIR QPPGKGLEWI GEINHSGSTN YNPSLKS..R
U2-47     QVQLQQWGAG LLKPSETLSL TCAVYGGSFS ..GYYWSWIR QPPGKGLEWI GEINHSGSTN YNPSLKS..R
U2-48     QVQLQQWGAG LLKPSETLSL TCAVYGGSFS ..GYYWSWIR QPPGKGLEWI GEINHSGSTN YNPSLKS..R
U2-49     QVQLQQWGAG LLKPSETLSL TCAVYGGSFS ..GYYWSWIR QPPGKGLEWI GEINHSGSTN YNPSLKS..R
U2-50     QVQLQQWGAG LLKPSETLSL TCAVYGGSFS ..GYYWSWIR QPPGKGLEWI GEINHSGSTN YNPSLKS..R
U2-51     QVQLQESGPG LVKPSETLSL TCTVSGGSIS S..YYWSWIR QPAGKGLEWI GRIYTSGTTN YNPSLKS..R
U2-52     QVQLQESGPG LVKPSETLSL TCTVSGGSVS SGGSYWSWIR QPPGKGLEWI GYIYYSGSTN YNPSLKS..R
U2-53     QVQLQESGPG LVKPSETLSL TCTVSGGSVS SGGSYWSWIR QPPGKGLEWI GYIYYSGSTN YNPSLKS..R
U2-54     EVQLVQSGAE LKKPGESLKI SCKGSGYRFT ..SYWIGWVR QMPGKGLEWM GIIYPDDSDT RYSPSFQG.Q
U2-55     EVQLVQSGAE VKKPGESLKI SCKGSGYSFT ..SYWIGWVR QMPGKGLEWM GIIYPDDSDA RYSPSFQG.Q
U2-56     EVQLVQSGAE VKKPGESLKI SCKGSGYSFT ..SYWIGWVR QMPGKGLEWM GIIYPGDSDI RYSPSFQG.Q
U2-57     QVQLQQSGPG LVKPSQTLSL TCAISGDSVS SYSAAWNWIR QSPSRGLEWL GRTYCRSKWY NDYAVSVKSR
U2-58     EVQLVESGGG LVQPGGSLRL SCAASGFTFS AYS   MNWVR QAPGKGLEWV SYISSSGRTI YYADSVKG.R
                                       CDR1                                CDR2
```

FIGURE 11B

```
              80         100                    120              135
U2-1    VTMTTDTSTS TAYMELRSLR SDDTAVYYCA REDNW....N YG........ FFDYWGQGTL VTVSS   (SEQ ID NO:142)
U2-2    VTMTTDTSTS TAYMELRSLR SDDTAVYYCA REDNW....N YG........ FFDYWGQGTL VTVSS   (SEQ ID NO:142)
U2-3    VTMTRDTSIS TAYMELSRLR SDDTAVYYCA R....SIAV. .......... ALDYWGQGTL VTVSS   (SEQ ID NO:143)
U2-4    VTMTRDTSIS TAYMELSRLR SDDTAVYYCA R....SIAV. .......... ALDYWGQGTL VTVSS   (SEQ ID NO:144)
U2-5    VTMLEDTSTD TAYMELSSLR SEDTAVYYCA TEG.DGG... .....YYYY GMDVWGQGTT VTVSS    (SEQ ID NO:145)
U2-6    VTMLEDTSTD TAYMELSSLR SEDTAVYYCA TEG.DGG... .....YYYY GMDVWGQGTT VTVSS    (SEQ ID NO:145)
U2-7    LTISKDTSKS QVVLTMTNMD PVDTATYYCA R........M YSSGWYG... VFDYWGQGTL VTVSS   (SEQ ID NO:146)
U2-8    LTISKDTSKS QVVLTMTNMD PVDTATYYCA R........V YSSGWS..FY GMDVWGQGTT VTVSS   (SEQ ID NO:147)
U2-9    LTITKDTSKN QVVLTMTNMD PVDTATYYCA H........R REL....... PFDYWGQGTL VTVSS   (SEQ ID NO:148)
U2-10   LTITKDTSKT QVVLTVTDMD PVDTATYYCA H........R NWT....... PFDYWGQGTL VTVSS   (SEQ ID NO:149)
U2-11   LTITKDTSKN QVVLTMTNMD PVDTATYYCA H........R LEL....... PFDYWGQGTL VTVSS   (SEQ ID NO:150)
U2-12   LTITKDTSKN QVVLTMTNLD PVDTATYYCA H........R REV....... PFDYWGQGTL VTVSS   (SEQ ID NO:151)
U2-13   LTITKATSKN QVVLTMTNMD PVDTATYYCA H........R HTN....... PFEYWGQGTL VTVSS   (SEQ ID NO:152)
U2-14   LTITKDTSKN QVVLTMTNMD PVDTATYYCA H........R GEL....... PFDYWGQGTL VTVSS   (SEQ ID NO:153)
U2-15   LTITKDTSKN QVVLTMTNMD PVDTATYYCA H........R GEL....... PFDYWGQGTL VTVSS   (SEQ ID NO:153)
U2-16   FTISRDNAKN SLYLQMNSLR AEDTAVYYCA R..DRVGAT. ........PD AFDIWGQGTM VTVSS   (SEQ ID NO:154)
U2-17   FTISRDNSKN TLYLQMNSLR AEDTAVYYCA KEGIAVAGTA E....YYYYY AMDVWGQGTT VTVSS   (SEQ ID NO:155)
U2-18   FTISRDNSKN TLYLQMNSLR AEDTAVYYCA KEG..IAARD .....SYYYY AMDVWGQGTT VTVSS   (SEQ ID NO:156)
U2-19   FTISRDNSKN TLYLQMNSLR AEDTAEYYCA KEG..IAGRD .....SYYYY GMDVWGQGTT VTVSS   (SEQ ID NO:157)
U2-20   FTISRDNSKN TLYLQMNSLR AEDTAEYYCA KEG..IAGRD .....SYYYY GMDVWGQGTT VTVSS   (SEQ ID NO:157)
U2-21   FTISRDNSKN TLYLQMNSLR AEDTAVYYCA R......SYY DSSGY...YY GFDYWGQGTL VTVSS   (SEQ ID NO:158)
U2-22   FTISRDNSMN TLYLQMNSLR AEDTAVYYCA R......SYY DSSGY...YY GFDYWGQGTL VTVSS   (SEQ ID NO:158)
U2-23   FTISRDNSKN TLYLQMNSLR AEDTAVYYCA R......... ..N....... VIDYWGQGTL VTVSS   (SEQ ID NO:159)
U2-24   FTISRDNSKN TLYLQMNSLR AEDTAVYYCA R......GG ATG.....AE YFQHWGQGTL VTVSS    (SEQ ID NO:160)
U2-25   FTISRDNSKN TLYLQMNSLR AEDTAVYYCA R......GG ATG.....AE YFQHWGQGTL VTVSS    (SEQ ID NO:160)
U2-26   FTISRDNSKN TLYLQMNSLR AEDTAVYYCV L...L....W FGE....... TFDYWGQGSL VTVSP   (SEQ ID NO:161)
U2-27   FTISRDNSKN TLYLQMNSLR AEDTAVYYCA R......... .NL....... PFDYWGQGTL VTVSS   (SEQ ID NO:162)
U2-28   FTVSRDNSKN TLFLQMNSLR AEDTAVYYCA R....SHYGG DYD.....YY GMDVWGQGTT VTVSS   (SEQ ID NO:163)
U2-29   FTISRDNSKN TLYLQMNSLR AEDTAVYYCA R.DGW....Q QQA....... PFDYWGQGTL VTVSS   (SEQ ID NO:164)
U2-30   FTISRDNSKN TLDLQMNSLR AEDTAVYYCA R...W....G ISA....... PFDCWGQGTL VTVSS   (SEQ ID NO:165)
U2-31   FTISRDNAKN SLFLQMNSLR DEDTAVYYCA L...W..... ..A....... PFDYWGQGTL VTVSS   (SEQ ID NO:166)
U2-32   FTISRDNAKN SVYLQMNSLR DEDTAVYYCA R..DGYNWNG GGN.....YY GMDVWGQGTT VTVSS   (SEQ ID NO:167)
U2-33   FTISRDNAKN SLYLQMNSLR DEDTAVYYCA R..DGYNWNN GGY.....YY GMDVWGQGTT VTVSS   (SEQ ID NO:168)
U2-34   FTISRDNAKN SLYLQMNSLR DEDTAVYYCA R..DGYNWNN GGY.....YY GMDVWGQGTT VTVSS   (SEQ ID NO:168)
U2-35   VTISVDTSKN QFSLNLSSVT AADTAVYYCA R......... .GP.....YY GMDVWGQGTT VTVSS   (SEQ ID NO:169)
U2-36   VNMSVDTSKN QFSLKLSSVT AADTAVYYCA R.....ALRG IVLMVYV.LG ALDIWGQGTK VTVSS   (SEQ ID NO:170)
U2-37   VNMSVDTSKN QFSLKLSSVT AADTAVYYCA R.....ALRG IVLMVYV.LG ALDIWGQGTK VTVSS   (SEQ ID NO:170)
U2-38   VTISADTSKN QFSLKLSSVT AADTAVYYCA R..DETVVRG LIR....YCY GMDVWGQGTT VTVSS   (SEQ ID NO:171)
U2-39   ITISADTSKN QFSLKLNSVT AADTAVYYCA R.....DRGG GD......YG RMDVWGQGTT VTVSS   (SEQ ID NO:172)
U2-40   ITISADTSKN QFSLKLNSVT AADTAVYYCA R.....DRGG GD......YG RMDVWGQGTT VTVSS   (SEQ ID NO:173)
U2-41   ITKSVDTSKN QFSLKLSSVT AADTAVYYCA R.SN.....N YG........ CFALWGRGTL VTVSS   (SEQ ID NO:174)
U2-42   ITKSVDTSKN QFSLKLSSVT AADTAVYYCA R.SN.....N YG........ CFALWGRGTL VTVSS   (SEQ ID NO:175)
U2-43   VTISVDTSKN QFSLKLSSVT AADTAVYYCA SGYNYGLYYY DSSGYPSYYY GMDVWGQGTT VTVSS   (SEQ ID NO:176)
U2-44   VTISVDTSKN QFSLKLFSVT AADTAVYFCA R.TYYDILTG YPF....... YFDYWGQGTL VTVSS   (SEQ ID NO:177)
U2-45   VTISVDTSKN QFSLKLFSVT AADTAVYFCA R.TYYDILTG YPF....... YFDYWGQGTL VTVSS   (SEQ ID NO:178)
U2-46   VTISVDTSKN QFSLKLSSVT AADTAVYYCA R...GGYSSS WY........ WFDHWGQGTL VTVSS   (SEQ ID NO:179)
U2-47   VTISVDTSKN QFSLKLSSVT AADTAVYYCA R...GGYSSS WF........ WFDHWGQGTL VTVSS   (SEQ ID NO:180)
U2-48   VTISVDTSKN QFSLKLSSVT AADTAVYYCA R...GGYSSS WF........ WFDHWGQGTL VTVSS   (SEQ ID NO:180)
U2-49   VTISVDTSKN QFSLKLSSVT AADTAVYYCA R...GGYSSS WF........ WFDHWGQGTL VTVSS   (SEQ ID NO:180)
U2-50   VTISVDTSKN QFSLKLSSVT AADTAVYYCA R...GGYSSS WF........ WFDHWGQGTL VTVSS   (SEQ ID NO:180)
U2-51   VTMSVDTSKN QFSLKLSSVT AADTAVYYCA R..DGYSYGH YYY......Y GMDVWGQGTT VTVSS   (SEQ ID NO:181)
U2-52   VTISIVTSRN QFSLKLSSVT AADTAVYYCA R....SALRY FDWLFS...D VSDIWGQGTM VTVSS   (SEQ ID NO:182)
U2-53   VTISIVTSRN QFSLKLSSVT AADTAVYYCA R....SALRY FDWLFS...D VSDIWGQGTM VTVSS   (SEQ ID NO:182)
U2-54   VTISADKSIS TAYLQWSSLK ASDTAMYYCA RQKSY....G YS........ YFDYWGQGTL VTVSS   (SEQ ID NO:183)
U2-55   VTISADKSIN TAYLQWSSLK ASDTAMYYCA R...QGYGSG W.G....... YFDYWGQGTL VTVSS   (SEQ ID NO:184)
U2-56   VTISADKSIN TAYLQWSSLK ASDTAMYYCA R..QGLAVAG TS...YYYYY GMDVWGQGTT VTVSS   (SEQ ID NO:185)
U2-57   ITINPDTSKN QFSLQLNSVT PEDTAVYYCA R.....DRAV AGY.....YY GMDVWGQGTT VTVSS   (SEQ ID NO:186)
U2-58   FTISRDNAKN SLFLQMNSLR DEDTAVYYCA L...W..... ..A....... PFDYWGQGTL VTVSS   (SEQ ID NO:166)
                                                 CDR3
```

U$_L$-1 light chain nucleotide sequence (SEQ ID NO:532)
gaygtngtnatgacncarwsnccnmtnwsnmtnccngtnacnmtnggncarccngcnwsnathw
sntgymgnwsnwsncarwsnmtngtntaywsngayggnaayacntaymtnaaytggttycarca
rmgnccnggncarwsnccnmgnmgnmtnathtayaargtnwsnaaytgggaywsnggngtnccn
gaymgnttyaayggnwsnggnwsnggnacngayttyacnmtnaarathwsnmgngtngargcng
argaygtnggngtntaytaytgyatgcarwsnacncaytggccnathacnttyggncarggnac
nmgnmtngarathaarmgnacngtngcngcnccnwsngtnttyathttyccnccnwsngaygar
carmtnaarwsnggnacngcnwsngtngtntgymtnmtnaayaayttytayccnmgngargcna
argtncartggaargtngayaaygcnmtncarwsnggnaaywsncargarwsngtnacngarca
rgaywsnaargaywsnacntaywsnmtnwsnwsnacnmtnacnmtnwsnaargcngaytaygar
aarcayaargtntaygcntgygargtnacncaycarggnmtnwsnwsnccngtnacnaarwsnt
tyaaymgnggngartgy

U$_L$-2 light chain nucleotide sequence (SEQ ID NO:533)
gaygtngtnatgacncarwsnccnmtnwsnmtnccngtnacnmtnggncarccngcnwsnathw
sntgymgnwsnwsncarwsnmtngtntaywsngayggnaayacntaymtnaaytggttycarca
rmgnccnggncarwsnccnmgnmgnmtnathtayaargtnwsnaaytgggaywsnggngtnccn
gaymgnttywsnggnwsnggnwsnggnacngayttyacnmtnaarathwsnmgngtngargcng
argaygtnggngtntaytaytgyathcarggnacncaytggccnacnacnttyggncarggnac
nmgnmtngarathaarmgnacngtngcngcnccnwsngtnttyathttyccnccnwsngaygar
carmtnaarwsnggnacngcnwsngtngtntgymtnmtnaayaayttytayccnmgngargcna
argtncartggaargtngayaaygcnmtncarwsnggnaaywsncargarwsngtnacngarca
rgaywsnaargaywsnacntaywsnmtnwsnwsnacnmtnacnmtnwsnaargcngaytaygar
aarcayaargtntaygcntgygargtnacncaycarggnmtnwsnwsnccngtnacnaarwsnt
tyaaymgnggngartgy

U$_L$-3 light chain nucleotide sequence (SEQ ID NO:534)
gaygtngtnatgacncarwsnccnmtnwsnmtnccngtnacnmtnggncarccngcnwsnathw
sntgymgnwsnwsncarwsnmtngtntaywsngayggnaayacntaymtnaaytggmtncarca
rmgnccnggncarwsnccnmgnmgnmtnathtayaargtnwsnaaytgggaywsnggngtnccn
gaymgnttywsnggnwsnggnwsnggnacngayttyacnmtnaarathwsnmgngtngargcng
argaygtnggngtntaytaytgyatgcarggnacncaytggccnathacnttyggncarggnac
nmgnmtngarathaarmgnacngtngcngcnccnwsngtnttyathttyccnccnwsngaygar
carmtnaarwsnggnacngcnwsngtngtntgymtnmtnaayaayttytayccnmgngargcna
argtncartggaargtngayaaygcnmtncarwsnggnaaywsncargarwsngtnacngarca
rgaywsnaargaywsnacntaywsnmtnwsnwsnacnmtnacnmtnwsnaargcngaytaygar
aarcayaargtntaygcntgygargtnacncaycarggnmtnwsnwsnccngtnacnaarwsnt
tyaaymgnggngartgy

FIGURE 13A

U$_L$-4 light chain nucleotide sequence (SEQ ID NO:534)
gaygtngtnatgacncarwsnccnmtnwsnmtnccngtnacnmtnggncarccngcnwsnathw
sntgymgnwsnwsncarwsnmtngtntaywsngayggnaayacntaymtnaaytggmtncarca
rmgnccnggncarwsnccnmgnmgnmtnathtayaargtnwsnaaytgggaywsnggngtnccn
gaymgnttywsnggnwsnggnwsnggnacngayttyacnmtnaarathwsnmgngtngargcng
argaygtnggngtntaytaytgyatgcarggnacncaytggccnathacnttyggncarggnac
nmgnmtngarathaarmgnacngtngcngcnccnwsngtnttyathttyccnccnwsngaygar
carmtnaarwsnggnacngcnwsngtngtntgymtnmtnaayaayttytayccnmgngargcna
argtncartggaargtngayaaygcnmtncarwsnggnaaywsncargarwsngtnacngarca
rgaywsnaargaywsnacntaywsnmtnwsnwsnacnmtnacnmtnwsnaargcngaytaygar
aarcayaargtntaygcntgygargtnacncaycarggnmtnwsnwsnccngtnacnaarwsnt
tyaaymgnggngartgy

U$_L$-5 light chain nucleotide sequence (SEQ ID NO:535)
gayathgtnatgacncaracnccnmtnwsnmtnwsngtnacnccnggncarccngcnwsnathw
sntgyaarwsnwsncarwsnmtnmtncaywsngayggnaaracntaymtntaytggtaymtnca
raarccnggncarccnccncarmtnmtnathtaygargtnwsnaaymgnttywsnggngtnccn
gaymgnttywsnggnwsnggnwsnggnacngayttyacnmtnaarathwsnmgngtngargcng
argaygtnggngtntaytaytgyatgcarggnathcarmtnccntgywsnttyggncarggnac
naarmtngarathaarmgnacngtngcngcnccnwsngtnttyathttyccnccnwsngaygar
carmtnaarwsnggnacngcnwsngtngtntgymtnmtnaayaayttytayccnmgngargcna
argtncartggaargtngayaaygcnmtncarwsnggnaaywsncargarwsngtnacngarca
rgaywsnaargaywsnacntaywsnmtnwsnwsnacnmtnacnmtnwsnaargcngaytaygar
aarcayaargtntaygcntgygargtnacncaycarggnmtnwsnwsnccngtnacnaarwsnt
tyaaymgnggngartgy

U$_L$-6 light chain nucleotide sequence (SEQ ID NO:536)
gayathgtnatgacncaracnccnmtnwsnmtnwsngtnacnccnggncarccngcnwsnathw
sntgyaarwsnwsncarwsnmtnmtncaywsngayggnaaracntaymtntaytggtaymtnca
raarccnggncarccnccncarmtnmtnathtaygargtnwsnaaymgnttywsnggngtnccn
gaymgnttywsnggnwsnggnwsnggnacngayttyacnmtnaarathwsnmgngtngargcng
argaygtnggngtntaytaytgyatgcarwsnathcarmtnccnmtnacnttyggnggnggnac
naargtngarathaarmgnacngtngcngcnccnwsngtnttyathttyccnccnwsngaygar
carmtnaarwsnggnacngcnwsngtngtntgymtnmtnaayaayttytayccnmgngargcna
argtncartggaargtngayaaygcnmtncarwsnggnaaywsncargarwsngtnacngarca
rgaywsnaargaywsnacntaywsnmtnwsnwsnacnmtnacnmtnwsnaargcngaytaygar
aarcayaargtntaygcntgygargtnacncaycarggnmtnwsnwsnccngtnacnaarwsnt
tyaaymgnggngartgy

FIGURE 13B

U$_L$-7 light chain nucleotide sequence (SEQ ID NO:536)
gayathgtnatgacncaracnccnmtnwsnmtnwsngtnacnccnggncarccngcnwsnathw
sntgyaarwsnwsncarwsnmtnmtncaywsngayggnaaracntaymtntaytggtaymtnca
raarccnggncarccnccncarmtnmtnathtaygargtnwsnaaymgnttywsnggngtnccn
gaymgnttywsnggnwsnggnwsnggnacngayttyacnmtnaarathwsnmgngtngargcng
argaygtnggngtntaytaytgyatgcarwsnathcarmtnccnmtnacnttyggnggnggnac
naargtngarathaarmgnacngtngcngcnccnwsngtnttyathttyccnccnwsngaygar
carmtnaarwsnggnacngcnwsngtngtntgymtnmtnaayaayttytayccnmgngargcna
argtncartggaargtngayaaygcnmtncarwsnggnaaywsncargarwsngtnacngarca
rgaywsnaargaywsnacntaywsnmtnwsnwsnacnmtnacnmtnwsnaargcngaytaygar
aarcayaargtntaygcntgygargtnacncaycarggnmtnwsnwsnccngtnacnaarwsnt
tyaaymgnggngartgy

U$_L$-8 light chain nucleotide sequence (SEQ ID NO:537)
gayathgtnatgacncaracnccnmtnwsnmtnwsngtnacnccnggncarccngcnwsnathw
sntgyaarwsnwsncarwsnmtnmtncaywsngayggnaaracntaymtntaytggttymtnca
raarccnggncarccnccncarccnmtnathtaygargtnwsnaaymgnttywsnggngtnccn
gaymgnttywsnggnwsnggnwsnggnacngayttyacnmtnaarathwsnmgngtngargcng
argaygtnggngtntaytaytgyatgcarwsnathcarmtnccnathacnttyggncayggnac
nmgnmtngarathaarmgnacngtngcngcnccnwsngtnttyathttyccnccnwsngaygar
carmtnaarwsnggnacngcnwsngtngtntgymtnmtnaayaayttytayccnmgngargcna
argtncartggaargtngayaaygcnmtncarwsnggnaaywsncargarwsngtnacngarca
rgaywsnaargaywsnacntaywsnmtnwsnwsnacnmtnacnmtnwsnaargcngaytaygar
aarcayaargtntaygcntgygargtnacncaycarggnmtnwsnwsnccngtnacnaarwsnt
tyaaymgnggngartgy

U$_L$-9 light chain nucleotide sequence (SEQ ID NO:537)
gayathgtnatgacncaracnccnmtnwsnmtnwsngtnacnccnggncarccngcnwsnathw
sntgyaarwsnwsncarwsnmtnmtncaywsngayggnaaracntaymtntaytggttymtnca
raarccnggncarccnccncarccnmtnathtaygargtnwsnaaymgnttywsnggngtnccn
gaymgnttywsnggnwsnggnwsnggnacngayttyacnmtnaarathwsnmgngtngargcng
argaygtnggngtntaytaytgyatgcarwsnathcarmtnccnathacnttyggncayggnac
nmgnmtngarathaarmgnacngtngcngcnccnwsngtnttyathttyccnccnwsngaygar
carmtnaarwsnggnacngcnwsngtngtntgymtnmtnaayaayttytayccnmgngargcna
argtncartggaargtngayaaygcnmtncarwsnggnaaywsncargarwsngtnacngarca
rgaywsnaargaywsnacntaywsnmtnwsnwsnacnmtnacnmtnwsnaargcngaytaygar
aarcayaargtntaygcntgygargtnacncaycarggnmtnwsnwsnccngtnacnaarwsnt
tyaaymgnggngartgy

FIGURE 13C

U$_L$-11 light chain nucleotide sequence (SEQ ID NO:538)
gayathcaratgacncarwsnccnwsnwsnmtnwsngcnwsngtnggngaymgngtnacnatha
cntgymgngcnwsncarggnathgcnaaytaymtngcntggtaycarcaraarccnggnaargt
nccnaarmtnmtnathtaygtngcnwsnacnmtncarwsnggngtnccnwsnmgnttywsnggn
wsnggnwsnggnacngayttyacnmtnacnathwsnwsnmtncarccngargaygtngcnacnt
aytaytgycaraaytayaaywsngcnccnttyacnttyggnccnggnacnaargtngayathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U$_L$-12 light chain nucleotide sequence (SEQ ID NO:539)
gayathcaratgacncarwsnccnwsnwsnmtnwsngcnwsngtnggngaymgngtnacnatha
thtgymgngcnwsncarggnathwsnaaygaymtngcntggtaycarcaraarccnggnaargt
nccnaarmtnmtnathtaygcngcnwsnacnmtncarwsnggngtnccnwsnmgnttywsnggn
wsnggnwsnggnacngayttyacnmtnacnathwsnwsnmtncarccngargaygtngcnacnt
aytaytgycaraartayaaywsngtnccnmtnacnttyggnggnggnacnaargtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U$_L$-13 light chain nucleotide sequence (SEQ ID NO:540)
aayathgtnatgacncaracnccnmtnwsnwsnccngtnacnmtnggncarccngcnwsnathw
sntgymgnwsnwsncarwsnmtngtncaywsngayggnaayacntaymtnwsntggmtncarca
rmgnccnggncarccnccnmgnmtnmtnathtayaarathwsnaaymgnttywsnggngtnccn
gaymgnttywsnggnwsnggngcnggnacngayttyacnmtnaarathwsnmgngtngargcng
argaygtnggngtntaytaytgyatgcargcnacncarttyccncayacnttyggnccnggnac
naargtngayathaarmgnacngtngcngcnccnwsngtnttyathttyccnccnwsngaygar
carmtnaarwsnggnacngcnwsngtngtntgymtnmtnaayaayttytayccnmgngargcna
argtncartggaargtngayaaygcnmtncarwsnggnaaywsncargarwsngtnacngarca
rgaywsnaargaywsnacntaywsnmtnwsnwsnacnmtnacnmtnwsnaargcngaytaygar
aarcayaargtntaygcntgygargtnacncaycarggnmtnwsnwsnccngtnacnaarwsnt
tyaaymgnggngartgy

FIGURE 13D

U<sub>L</sub>-14 light chain nucleotide sequence (SEQ ID NO:540)
aayathgtnatgacncaracnccnmtnwsnwsnccngtnacnmtnggncarccngcnwsnathw
sntgymgnwsnwsncarwsnmtngtncaywsngayggnaayacntaymtnwsntggmtncarca
rmgnccnggncarccnccnmgnmtnmtnathtayaarathwsnaaymgnttywsnggngtnccn
gaymgnttywsnggnwsnggngcnggnacngayttyacnmtnaarathwsnmgngtngargcng
argaygtnggngtntaytaytgyatgcargcnacncarttyccncayacnttyggnccnggnac
naargtngayathaarmgnacngtngcngcnccnwsngtnttyathttyccnccnwsngaygar
carmtnaarwsnggnacngcnwsngtngtntgymtnmtnaayaayttytayccnmgngargcna
argtncartggaargtngayaaygcnmtncarwsnggnaaywsncargarwsngtnacngarca
rgaywsnaargaywsnacntaywsnmtnwsnwsnacnmtnacnmtnwsnaargcngaytaygar
aarcayaargtntaygcntgygargtnacncaycarggnmtnwsnwsnccngtnacnaarwsnt
tyaaymgnggngartgy

U<sub>L</sub>-15 light chain nucleotide sequence (SEQ ID NO:541)
garathgtnatgacncaracnccnmtnwsnwsnccngtnacnmtnggncarccngcnwsnathw
sntgymgnwsnwsncarwsnmtngtncaywsngayggnaayacntaymtnwsntggmtncarca
rmgnccnggncarccnccnmgnmtnmtnathtayaarathwsnaaymgnttywsnggngtnccn
gaymgnttywsnggnacnggngcnggnacngayttyacnmtnaarathwsnmgngtngargcng
argaygtnggngtntaytaytgyatgcargcnacncarttyccncayacnttyggnggnggnac
naargtngarathaarmgnacngtngcngcnccnwsngtnttyathttyccnccnwsngaygar
carmtnaarwsnggnacngcnwsngtngtntgymtnmtnaayaayttytayccnmgngargcna
argtncartggaargtngayaaygcnmtncarwsnggnaaywsncargarwsngtnacngarca
rgaywsnaargaywsnacntaywsnmtnwsnwsnacnmtnacnmtnwsnaargcngaytaygar
aarcayaargtntaygcntgygargtnacncaycarggnmtnwsnwsnccngtnacnaarwsnt
tyaaymgnggngartgy

U<sub>L</sub>-16 light chain nucleotide sequence (SEQ ID NO:542)
garathgtnmtnacncarwsnccnggnacnmtnwsnmtnwsnccnggngarmgngcnacnmtnw
sntgymgngcnwsncaracngtnathwsnwsntaymtngcntggtaycarcaraarccnggnca
rgcnccnmgnmtnmtnathwsnggngcnwsnwsnmgngcnacnggnathccngaymgnttywsn
ggnwsnggnwsnggnacngayttyacnmtnacnathwsnmgnmtngarccngargayttygcng
tntaytaytgycarcartayggnwsnwsnccnmgnacnttyggncarggnacnaargtngarat
haarmgnacngtngcngcnccnwsngtnttyathttyccnccnwsngaygarcarmtnaarwsn
ggnacngcnwsngtngtntgymtnmtnaayaayttytayccnmgngargcnaargtncartgga
argtngayaaygcnmtncarwsnggnaaywsncargarwsngtnacngarcargaywsnaarga
ywsnacntaywsnmtnwsnwsnacnmtnacnmtnwsnaargcngaytaygaraarcayaargtn
taygcntgygargtnacncaycarggnmtnwsnwsnccngtnacnaarwsnttyaaymgnggng
artgy

FIGURE 13E

U$_L$-17 light chain nucleotide sequence (SEQ ID NO:543)
garathgtnmtnacncarwsnccnggnacnmtnwsnmtnwsnccnggngarmgngcnacnmtnw
sntgymgngcnwsncarwsngtnwsnmgnmtngcntggtaycarcaraarccnggncargcncc
nmgnmtnmtnathtayggngcnwsnmgnmgngcnacnggnathccngaymgnttywsnggnwsn
ggnwsnggnacngayttyacnmtnacnathwsnmgnmtngarccngargayttygcngtntayt
aytgycarcartayggnwsnwsnccnmgnwsnttyggncarggnacnaarmtngarathaarmg
nacngtngcngcnccnwsngtnttyathttyccnccnwsngaygarcarmtnaarwsnggnacn
gcnwsngtngtntgymtnmtnaayaayttytayccnmgngargcnaargtncartggaargtng
ayaaygcnmtncarwsnggnaaywsncargarwsngtnacngarcargaywsnaargaywsnac
ntaywsnmtnwsnwsnacnmtnacnmtnwsnaargcngaytaygaraarcayaargtntaygcn
tgygargtnacncaycarggnmtnwsnwsnccngtnacnaarwsnttyaaymgnggngartgy

U$_L$-18 light chain nucleotide sequence (SEQ ID NO:544)

U$_L$-20 light chain nucleotide sequence (SEQ ID NO:545)
gayathgtnatgacncarwsnccngaywsnmtngcngtnwsnmtnggngarmgngcnacnatha
aytgyaarwsnwsncarwsngtnmtntaywsnwsnaayaayaaraaytaymtngtntggtayca
rcaraarccnggncarccnccnaarmtnttyathtaytgggcnwsnacnmgngarwsnggngtn
ccngaymgnttyacnggnwsnggnwsnggnacngayttyacnmtnacnathwsnwsnmtncarg
cngargaygtngcngtntaytaytgycarcartaytaywsnttyccntggacnttyggncargg
nacnaargtngarathaarmgnacngtngcngcnccnwsngtnttyathttyccnccnwsngay
garcarmtnaarwsnggnacngcnwsngtngtntgymtnmtnaayaayttytayccnmgngarg
cnaargtncartggaargtngayaaygcnmtncarwsnggnaaywsncargarwsngtnacnga
rcargaywsnaargaywsnacntaywsnmtnwsnwsnacnmtnacnmtnwsnaargcngaytay
garaarcayaargtntaygcntgygargtnacncaycarggnmtnwsnwsnccngtnacnaarw
snttyaaymgnggngartgy

U$_L$-21 light chain nucleotide sequence (SEQ ID NO:546)
gayathgtnatgacncarwsnccngaywsnmtngcngtnwsnmtnggngarmgngcnacnatha
aytgyaarwsnwsncarwsngtnmtntaywsnwsnaayaayaaraaytaymtngcntggtayca
rcaraarccnggncarccnccnaarmtnmtnathtaytgggcnwsnacnmgngarwsnggngtn
ccngaymgnttywsnggnwsnggnwsnggnacngayttyacnmtnacnathwsnwsnmtncarg
cngargaygtngcngtntaytaytgycarcartaytaywsnacnacntggacnttyggncargg
nacnaargtngarathaarmgnacngtngcngcnccnwsngtnttyathttyccnccnwsngay
garcarmtnaarwsnggnacngcnwsngtngtntgymtnmtnaayaayttytayccnmgngarg
cnaargtncartggaargtngayaaygcnmtncarwsnggnaaywsncargarwsngtnacnga
rcargaywsnaargaywsnacntaywsnmtnwsnwsnacnmtnacnmtnwsnaargcngaytay
garaarcayaargtntaygcntgygargtnacncaycarggnmtnwsnwsnccngtnacnaarw
snttyaaymgnggngartgy

U$_L$-22 light chain nucleotide sequence (SEQ ID NO:547)
gayathgtnatgacncarwsnccngaywsnmtngcngtnwsnmtnggngarmgngcnacnatha
aytgyaarwsnwsncaraaygtnmtntaywsnwsnaayaayaaraaytaymtngcntggtayca
rcaraarccnggncarccnccnaarmtnmtnathtaytgggcnwsnacnmgngarwsnggngtn
ccngaymgnttywsnggnwsnggnwsnggnacngayttyacnmtnacnathwsnwsnmtncarg
cngargaygtngcngtntayttytgycarcartaytayggnacnccnmgnacnttyggncargg
nacnaargtngarathaarmgnacngtngcngcnccnwsngtnttyathttyccnccnwsngay
garcarmtnaarwsnggnacngcnwsngtngtntgymtnmtnaayaayttytayccnmgngarg
cnaargtncartggaargtngayaaygcnmtncarwsnggnaaywsncargarwsngtnacnga
rcargaywsnaargaywsnacntaywsnmtnwsnwsnacnmtnacnmtnwsnaargcngaytay
garaarcayaargtntaygcntgygargtnacncaycarggnmtnwsnwsnccngtnacnaarw
snttyaaymgnggngartgy

FIGURE 13G

U<sub>L</sub>-23 light chain nucleotide sequence (SEQ ID NO:548)
gayathgtnatgacncarwsnccngaywsnmtngcngtnwsnmtnggngarmgngcnacnatha
aytgyaarwsnwsncaraaygtnmtntaywsnwsnaayaayaaraaytaymtngcntggtayca
rcaraarccnggncarccnccnaarmtnmtnathtaytgggcnwsnacnmgngarwsnggngtn
ccngaymgnttywsnggnwsnggnwsnggnacngayttyacnmtnacnathwsnwsnmtncarg
cngargaygtngcngtntayttytgycarcartaytayggnacnccnmgnacnttyggncargg
nacnaargtngarathaarmgnacngtngcngcnccnwsngtnttyathttyccnccnwsngay
garcarmtnaarwsnggnacngcnwsngtngtntgymtnmtnaayaayttytayccnmgngarg
cnaargtncartggaargtngayaaygcnmtncarwsnggnaaywsncargarwsngtnacnga
rcargaywsnaargaywsnacntaywsnmtnwsnwsnacnmtnacnmtnwsnaargcngaytay
garaarcayaargtntaygcntgygargtnacncaycarggnmtnwsnwsnccngtnacnaarw
snttyaaymgnggngartgy

U<sub>L</sub>-24 light chain nucleotide sequence (SEQ ID NO:549)
gayathgtnatgacncarwsnccngaywsnmtnacngtnwsnmtnggngarmgngcnacnatha
aytgyaarwsnwsncarwsngtnmtntaywsnwsnaayaayaaraaytaymtngcntggtayca
rcaraarccnggncarccnccnaarmtnmtnathtaytgggcnwsnacnmgngarwsnggngtn
ccngaymgnttyggnggnwsnggnwsnggnacngayttyacnmtnacnathwsnwsnmtncarg
cngargaygtngcngtntaytaytgycarcartaytaywsnathwsnmgnacnttyggncargg
nacnaargtngarathaarmgnacngtngcngcnccnwsngtnttyathttyccnccnwsngay
garcarmtnaarwsnggnacngcnwsngtngtntgymtnmtnaayaayttytayccnmgngarg
cnaargtncartggaargtngayaaygcnmtncarwsnggnaaywsncargarwsngtnacnga
rcargaywsnaargaywsnacntaywsnmtnwsnwsnacnmtnacnmtnwsnaargcngaytay
garaarcayaargtntaygcntgygargtnacncaycarggnmtnwsnwsnccngtnacnaarw
snttyaaymgnggngartgy

U<sub>L</sub>-25 light chain nucleotide sequence (SEQ ID NO:549)
gayathgtnatgacncarwsnccngaywsnmtnacngtnwsnmtnggngarmgngcnacnatha
aytgyaarwsnwsncarwsngtnmtntaywsnwsnaayaayaaraaytaymtngcntggtayca
rcaraarccnggncarccnccnaarmtnmtnathtaytgggcnwsnacnmgngarwsnggngtn
ccngaymgnttyggnggnwsnggnwsnggnacngayttyacnmtnacnathwsnwsnmtncarg
cngargaygtngcngtntaytaytgycarcartaytaywsnathwsnmgnacnttyggncargg
nacnaargtngarathaarmgnacngtngcngcnccnwsngtnttyathttyccnccnwsngay
garcarmtnaarwsnggnacngcnwsngtngtntgymtnmtnaayaayttytayccnmgngarg
cnaargtncartggaargtngayaaygcnmtncarwsnggnaaywsncargarwsngtnacnga
rcargaywsnaargaywsnacntaywsnmtnwsnwsnacnmtnacnmtnwsnaargcngaytay
garaarcayaargtntaygcntgygargtnacncaycarggnmtnwsnwsnccngtnacnaarw
snttyaaymgnggngartgy

FIGURE 13H

U<sub>L</sub>-26 light chain nucleotide sequence (SEQ ID NO:550)
gayathgtnatgacncarwsnccngaywsnmtngcngtnwsnmtnggngarmgngcnacnatha
aytgyaarwsnwsncarwsngtnmtntayaaywsnaayaayaaraaytaymtngcntggtayca
rcaraarccnggncarccnccnaarmtnmtnathtaytgggcnwsnacnmgngarwsnggngtn
ccngaymgnttywsnggnwsnggnwsnggnacngayttyacnmtnacnathwsnwsnmtncarg
cngaygaygtngcngtntaytaytgycarcartaytaywsnacnacntggacnttyggnccngg
nacnaargtngarathaarmgnacngtngcngcnccnwsngtnttyathttyccnccnwsngay
garcarmtnaarwsnggnacngcnwsngtngtntgymtnmtnaayaayttytayccnmgngarg
cnaargtncartggaargtngayaaygcnmtncarwsnggnaaywsncargarwsngtnacnga
rcargaywsnaargaywsnacntaywsnmtnwsnwsnacnmtnacnmtnwsnaargcngaytay
garaarcayaargtntaygcntgygargtnacncaycarggnmtnwsnwsnccngtnacnaarw
snttyaaymgnggngartgy U<sub>L</sub>-27 light chain nucleotide sequence (SEQ ID NO:551)
gayathgtnatgacncarwsnccngaywsnmtngcngtnwsnmtnggngarmgngcnacnatha
aytgyaarwsnwsncarwsngtnmtntayaaywsnaayaayaaraaytaymtngcntggtayca
rcaraarccnggncarccnccnaarmtnmtnathtaytgggcnwsnacnmgngarwsnggngtn
ccngaymgnttywsnggnwsnggnwsnggnacngayttyacnmtnacnathwsnwsnmtncarg
cngaygaygtngcngtntaytaytgycarcartaytaywsnacnacntggacnttyggnccngg
nacnaargtngarathaarmgnacngtngcngcnccnwsngtnttyathttyccnccnwsngay
garcarmtnaarwsnggnacngcnwsngtngtntgymtnmtnaayaayttytayccnmgngarg
cnaargtncartggaargtngayaaygcnmtncarwsnggnaaywsncargarwsngtnacnga
rcargaywsnaargaywsnacntaywsnmtnwsnwsnacnmtnacnmtnwsnaargcngaytay
garaarcayaargtntaygcntgygargtnacncaycarggnmtnwsnwsnccngtnacnaarw
snttyaaymgnggngartgy U<sub>L</sub>-28 light chain nucleotide sequence (SEQ ID NO:552)
gayathgtnatgacncarwsnccngaywsnmtngcngtnwsnmtnggngarmgngcnacnatha
aytgyaarwsnwsncarwsngtnmtntaywsnwsnaayaayaaraaytaymtngcntggtayca
rcaraarccnggncarccnccnaargtnmtnathtaytgggcnwsnacnmgnaarwsnggngtn
ccngaymgnttywsnggnwsnggnwsnggnacngayttyacnmtnacnathwsnggnmtncarg
cngargaygtngcnmtntaytaytgycarcartaytaywsnacnatgttywsnttyggncargg
nacnaarmtngarathaarmgnacngtngcngcnccnwsngtnttyathttyccnccnwsngay
garcarmtnaarwsnggnacngcnwsngtngtntgymtnmtnaayaayttytayccnmgngarg
cnaargtncartggaargtngayaaygcnmtncarwsnggnaaywsncargarwsngtnacnga
rcargaywsnaargaywsnacntaywsnmtnwsnwsnacnmtnacnmtnwsnaargcngaytay
garaarcayaargtntaygcntgygargtnacncaycarggnmtnwsnwsnccngtnacnaarw
snttyaaymgnggngartgy

FIGURE 131

L-29 light chain nucleotide sequence (SEQ ID NO:552)
gayathgtnatgacncarwsnccngaywsnmtngcngtnwsnmtnggngarmgngcnacnatha
aytgyaarwsnwsncarwsngtnmtntaywsnwsnaayaayaaraaytaymtngcntggtayca
rcaraarccnggncarccnccnaargtnmtnathtaytgggcnwsnacnmgnaarwsnggngtn
ccngaymgnttywsnggnwsnggnwsnggnacngayttyacnmtnacnathwsnggnmtncarg
cngargaygtngcnmtntaytaytgycarcartaytaywsnacnatgttywsnttyggncargg
nacnaarmtngarathaarmgnacngtngcngcnccnwsngtnttyathttyccnccnwsngay
garcarmtnaarwsnggnacngcnwsngtngtntgymtnmtnaayaayttytayccnmgngarg
cnaargtncartggaargtngayaaygcnmtncarwsnggnaaywsncargarwsngtnacnga
rcargaywsnaargaywsnacntaywsnmtnwsnwsnacnmtnacnmtnwsnaargcngaytay
garaarcayaargtntaygcntgygargtnacncaycarggnmtnwsnwsnccngtnacnaarw
snttyaaymgnggngartgy

U$_L$-30 light chain nucleotide sequence (SEQ ID NO:553)
gayathgtnatgacncarwsnccngaywsnmtngcngtnwsnmtnggngarmgngcnacnatha
aytgyaarwsnwsncarwsngtnmtngaywsnwsnaayaayaaraaytaymtngcntggtayca
rcaraarccnggncarccnccnaarmtnmtnathtaytgggcnwsnacnmgnarwsnggngtn
ccngaymgnttywsnggnwsnggnwsnggnacngayttyacnmtnacnathwsnwsnmtncarg
cngargaygtngcgtnttytaytgycaycartaytaywsnacnccnmtnacnttyggnggngg
nacnaargtngcnathaarmgnacngtngcngcnccnwsngtnttyathttyccnccnwsngay
garcarmtnaarwsnggnacngcnwsngtngtntgymtnmtnaayaayttytayccnmgngarg
cnaargtncartggaargtngayaaygcnmtncarwsnggnaaywsncargarwsngtnacnga
rcargaywsnaargaywsnacntaywsnmtnwsnwsnacnmtnacnmtnwsnaargcngaytay
garaarcayaargtntaygcntgygargtnacncaycarggnmtnwsnwsnccngtnacnaarw
snttyaaymgnggngartgy

U$_L$-31 light chain nucleotide sequence (SEQ ID NO:553)
gayathgtnatgacncarwsnccngaywsnmtngcngtnwsnmtnggngarmgngcnacnatha
aytgyaarwsnwsncarwsngtnmtngaywsnwsnaayaayaaraaytaymtngcntggtayca
rcaraarccnggncarccnccnaarmtnmtnathtaytgggcnwsnacnmgnarwsnggngtn
ccngaymgnttywsnggnwsnggnwsnggnacngayttyacnmtnacnathwsnwsnmtncarg
cngargaygtngcgtnttytaytgycaycartaytaywsnacnccnmtnacnttyggnggngg
nacnaargtngcnathaarmgnacngtngcngcnccnwsngtnttyathttyccnccnwsngay
garcarmtnaarwsnggnacngcnwsngtngtntgymtnmtnaayaayttytayccnmgngarg
cnaargtncartggaargtngayaaygcnmtncarwsnggnaaywsncargarwsngtnacnga
rcargaywsnaargaywsnacntaywsnmtnwsnwsnacnmtnacnmtnwsnaargcngaytay
garaarcayaargtntaygcntgygargtnacncaycarggnmtnwsnwsnccngtnacnaarw
snttyaaymgnggngartgy

FIGURE 13J

U$_L$-32 light chain nucleotide sequence (SEQ ID NO:554)
gayathgtnatgacncarwsnccngaywsnmtngcngtnwsnmtnggngarmgngcnacnatha
aytgyaarwsnwsncarwsnathmtntaymgnwsnaayaayaaraaytaymtngcntggtayca
rcaraarccnggncarccnccnaarmtnmtnathtaytgggcnwsngcnmgngarwsnggngtn
ccngaymgnttywsnggnwsnggnwsnggnacngayttyacnmtnacnathwsnwsnmtncarg
cngargaygtngcngtntayttytgycarcartayttyathacnccnmtnacnttyggnggngg
nacnaargtngarathaarmgnacngtngcngcnccnwsngtnttyathttyccnccnwsngay
garcarmtnaarwsnggnacngcnwsngtngtntgymtnmtnaayaayttytayccnmgngarg
cnaargtncartggaargtngayaaygcnmtncarwsnggnaaywsncargarwsngtnacnga
rcargaywsnaargaywsnacntaywsnmtnwsnwsnacnmtnacnmtnwsnaargcngaytay
garaacayaargtntaygcntgygargtnacncaycarggnmtnwsnwsnccngtnacnaarw
snttyaaymgnggngartgy

U$_L$-33 light chain nucleotide sequence (SEQ ID NO:554)
gayathgtnatgacncarwsnccngaywsnmtngcngtnwsnmtnggngarmgngcnacnatha
aytgyaarwsnwsncarwsnathmtntaymgnwsnaayaayaaraaytaymtngcntggtayca
rcaraarccnggncarccnccnaarmtnmtnathtaytgggcnwsngcnmgngarwsnggngtn
ccngaymgnttywsnggnwsnggnwsnggnacngayttyacnmtnacnathwsnwsnmtncarg
cngargaygtngcngtntayttytgycarcartayttyathacnccnmtnacnttyggnggngg
nacnaargtngarathaarmgnacngtngcngcnccnwsngtnttyathttyccnccnwsngay
garcarmtnaarwsnggnacngcnwsngtngtntgymtnmtnaayaayttytayccnmgngarg
cnaargtncartggaargtngayaaygcnmtncarwsnggnaaywsncargarwsngtnacnga
rcargaywsnaargaywsnacntaywsnmtnwsnwsnacnmtnacnmtnwsnaargcngaytay
garaacayaargtntaygcntgygargtnacncaycarggnmtnwsnwsnccngtnacnaarw
snttyaaymgnggngartgy

U$_L$-34 light chain nucleotide sequence (SEQ ID NO:555)
gayathcaratgacncarwsnccnwsnwsnmtnwsngcnwsngtnggngaymgngtnacnatha
cntgymgngcnwsncargayathwsncaytaymtngcntggttycarcaraarccnggnaargc
nccnaarwsnmtnathtaygcngcnwsnwsnmtncarwsnggngtnccnwsnaarttywsnggn
wsnggnwsnggnacngayttyacnmtnacnathwsnwsnmtncarccngargayttygcnacnt
aytaytgycarcartayaayaaytayccnttyacnttyggnccnggnacnaargtngayathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraacayaargtntay
gcntgygargtnacncaycarggnmtnwsnwsnccngtnacnaarwsnttyaaymgnggngart
gy

FIGURE 13K

U$_L$-35 light chain nucleotide sequence (SEQ ID NO:556)
gayathcaratgacncarwsnccnwsnwsnmtnwsngcnwsngtnggngaymgngtngcnatha
cntgymgngcnwsncargayathwsnaaytaymtngcntggmtncarcaraarccnggnaargc
nccnaarwsnmtnathtaygcngcnwsnwsnmtncarwsnggngtnccnwsnmgnttywsnggn
wsnggnwsnggnacngayttyacnmtnacnathwsnwsnmtncarccngargayttygcnacnt
aytaytgycarcartayaayacntayccnttyacnttyggnccnggnacnaaratggayathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U$_L$-36 light chain nucleotide sequence (SEQ ID NO:557)
garathgtnatgacncarwsnccngcnacnmtnwsngtnwsnccnggngarmgngcnacnmtnw
sntgymgngcnwsncarwsngtnwsnwsnaaymtngcntggtaycarcargayccnggncargc
nccnmgnmtnmtnathtayggngcnwsnmgnmgngcnacnggnathccngcnmgnttywsnggn
wsnggnwsnggnacngarttyacnmtnacnathwsnwsnmtncarwsngargayttygcngtnt
aytaytgycarcarcayaayaaytggccnccntggacnttyggncarggnacnaargtngarat
haarmgnacngtngcngcnccnwsngtnttyathttyccnccnwsngaygarcarmtnaarwsn
ggnacngcnwsngtngtntgymtnmtnaayaayttytayccnmgngargcnaargtncartgga
argtngayaaygcnmtncarwsnggnaaywsncargarwsngtnacngarcargaywsnaarga
ywsnacntaywsnmtnwsnwsnacnmtnacnmtnwsnaargcngaytaygaraarcayaargtn
taygcntgygargtnacncaycarggnmtnwsnwsnccngtnacnaarwsnttyaaymgnggng
artgy

U$_L$-37 light chain nucleotide sequence (SEQ ID NO:557)
garathgtnatgacncarwsnccngcnacnmtnwsngtnwsnccnggngarmgngcnacnmtnw
sntgymgngcnwsncarwsngtnwsnwsnaaymtngcntggtaycarcargayccnggncargc
nccnmgnmtnmtnathtayggngcnwsnmgnmgngcnacnggnathccngcnmgnttywsnggn
wsnggnwsnggnacngarttyacnmtnacnathwsnwsnmtncarwsngargayttygcngtnt
aytaytgycarcarcayaayaaytggccnccntggacnttyggncarggnacnaargtngarat
haarmgnacngtngcngcnccnwsngtnttyathttyccnccnwsngaygarcarmtnaarwsn
ggnacngcnwsngtngtntgymtnmtnaayaayttytayccnmgngargcnaargtncartgga
argtngayaaygcnmtncarwsnggnaaywsncargarwsngtnacngarcargaywsnaarga
ywsnacntaywsnmtnwsnwsnacnmtnacnmtnwsnaargcngaytaygaraarcayaargtn
taygcntgygargtnacncaycarggnmtnwsnwsnccngtnacnaarwsnttyaaymgnggng
artgy

FIGURE 13L

U<sub>L</sub>-38 light chain nucleotide sequence (SEQ ID NO:558)
gayathcaratgacncarwsnccnwsnwsngtnwsngcnwsngtnggngaymgngtnacnatha
cntgymgngcnwsncargayathwsnmgntggmtngcntggtaycarcaraarccnggnaargc
nccnaarmtnmtnathtaygcngcnwsnwsnmtncarwsnggngtnccnwsnmgnttywsnggn
wsnggnwsnggnacngayttyacnmtnacnathwsnwsnmtncarccngargayttygcnacnt
aytaytgycarcargcnaaywsnttyccnccnacnttyggncarggnacnaargtngarttyaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U<sub>L</sub>-39 light chain nucleotide sequence (SEQ ID NO:559)
gayathcaratgacncarwsnccnwsnwsnmtnwsngcnwsngtnggngaymgngtnacnatha
cntgymgngcnwsncarwsnathwsnacntaymtnaaytggtaycarcaraarccnggnaargc
nccnaarttymtnathtaygcngcnwsnwsnmtncarwsnggngtnccnwsnmgnttywsnggn
wsnggnwsnggnacngayttyacnmtnacnathwsnwsnmtncarccngargayttygcngcnt
aytaytgycarcarwsncaywsngcnccnttyacnttyggnccnggnacnaargtngayathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U<sub>L</sub>-40 light chain nucleotide sequence (SEQ ID NO:560)
gayathcaratgacncarwsnccnwsnwsnmtnwsngcnwsnmtnggngaymgngtnacnatha
cntgymgngcnwsncaracnathwsnathtaymtnaaytggtaycarcaraarccnggnaargc
nccnaarmtnmtnathtaygcngcnwsnwsnmtncarwsnggngtnccnwsnmgnttywsnggn
wsnggnwsnggnacngayttyacnmtnacnathwsnwsnmtncarccngargayttygcnacnt
aytaytgycarcarwsntaywsnacnmtnacnttyggnggnggnacnaargtngarathaarmg
nacngtngcngcnccnwsngtnttyathttyccnccnwsngaygarcarmtnaarwsnggnacn
gcnwsngtngtntgymtnmtnaayaayttytayccnmgngargcnaargtncartggaargtng
ayaaygcnmtncarwsnggnaaywsncargarwsngtnacngarcargaywsnaargaywsnac
ntaywsnmtnwsnwsnacnmtnacnmtnwsnaargcngaytaygaraarcayaargtntaygcn
tgygargtnacncaycarggnmtnwsnwsnccngtnacnaarwsnttyaaymgnggngartgy

FIGURE 13M

U<sub>L</sub>-41 light chain nucleotide sequence (SEQ ID NO:561)
gayathcaratgacncarwsnccnwsnwsnmtnwsngcnwsngtnggngaymgngtnacnatha
cntgymgngcnwsncarwsnathmgnwsntaymtnaaytggtaycarcarmgnccnggnaaygc
nccnaarmtnmtnathtaygcngcnwsnwsnmtncarwsnggngtnccnwsnmgngtnwsnggn
wsnggnwsnggnacngayttyacnmtnacnathmgnwsnmtncarccngargayttygcnacnt
aytaytgycarcarwsntaywsnathccnmtnacnttyggnggnggnacnaargtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U<sub>L</sub>-42 light chain nucleotide sequence (SEQ ID NO:562)
gayathcaratgacncarwsnccnwsnwsnmgnwsngcnwsngtnggngaymgngtnacnatha
cntgymgngcnwsncaracnathwsnmgntaymtnaaytggtaycarcaraarccnggnaargc
nccnaarmtnmtnathtaygcngcnwsnacnmtncarwsnggngtnccnwsnmgnttywsnggn
wsnggnwsnggnacngayttyacnmtnacnmtnwsnwsnmtncarccngargayttygcnacnt
aytaytgycarcarathtaywsnacnwsnathacnttyggncarggnacnmgnmtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U<sub>L</sub>-43 light chain nucleotide sequence (SEQ ID NO:563)
gayathcaratgacncarwsnccnwsnwsnmtnwsngcnwsngtnggngaymgngtnacnatha
cntgymgngcnwsncarmgnathwsnwsntaymtnaaytggtaycarcaraarccnggnaargc
nccnaargtnmtnathtaygcngarwsnwsnmtncarwsnggngtnccnwsnmgnttywsnggn
wsnggnwsnggnacngayttyacnmtnacnathwsnwsnmtncarccngargayttygcnacnt
aytaytgycarcarwsntayathacnccnathacnttyggncarggnacnmgnmtngarathat
hmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

FIGURE 13N

U<sub>L</sub>-44 light chain nucleotide sequence (SEQ ID NO:564)
gayathcaratgacncarwsnccnwsnwsnmtnwsngcnwsngtnggngaymgngtnacnatha
cntgymgngcnwsncarwsnathwsnmgntaymtnaaytggtaycarcaraarccnggnaargc
nccnaarmtnmtnathtayacngcnwsnwsnmtncarwsnggngtnccnwsnmgnttywsnggn
wsnggnwsnggnacngayttyacnmtnacnathwsnwsnmtncarccngaraayttygcnacnt
aytaytgycarcarwsntayttyacnccnathacnttyggncarggnacnmgnmtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy U<sub>L</sub>-45 light chain nucleotide sequence (SEQ ID NO:565)
gayathcaratgacncarwsnccnwsnwsnmtnwsngcnwsngtnggngaymgngtnacnatha
cntgymgngcnwsncarwsnathwsnwsntaymtnaaytggtaycarcaraarccnggnaargc
nccnaarmtnmtnathtayacngcnwsnwsnmtncarwsnggngtnccnwsnmgnttywsnggn
wsnggnwsnggnacngayttyacnmtnacnttywsnwsnmtncarccngargayttygcnacnt
aytaytgycarcarwsntayttywsnccnathacnttyggncarggnacnmgnmtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy U<sub>L</sub>-46 light chain nucleotide sequence (SEQ ID NO:566)
gayathcaratgacncarwsnccnwsnwsnmtnwsngcnwsngtnggngaymgngtnacnatha
cntgymgngcnwsncarwsnathwsnwsntaymtnaaytggtaycarcaraarccnggnaargc
nccnaarmtnmtnathtayacngcnwsnwsnmtncarwsnggngtnccnwsnmgnttywsnggn
wsnggnwsnggnacngayttyacnmtnacnmtnwsnwsnmtncarccngargayttygcnwsnt
aytaytgycarcarwsnttytayacnccnathacnttyggncarggnacnmgnmtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

FIGURE 13O

U<sub>L</sub>-47 light chain nucleotide sequence (SEQ ID NO:566)
gayathcaratgacncarwsnccnwsnwsnmtnwsngcnwsngtnggngaymgngtnacnatha
cntgymgngcnwsncarwsnathwsnwsntaymtnaaytggtaycarcaraarccnggnaargc
nccnaarmtnmtnathtayacngcnwsnwsnmtncarwsnggngtnccnwsnmgnttywsnggn
wsnggnwsnggnacngayttyacnmtnacnmtnwsnwsnmtncarccngargayttygcnwsnt
aytaytgycarcarwsnttytayacnccnathacnttyggncarggnacnmgnmtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U<sub>L</sub>-48 light chain nucleotide sequence (SEQ ID NO:567)
gayathcaratgacncarwsnccnwsnwsnmtnwsngcnwsngtnggngaymgngtnacnatha
cntgymgngcnwsncarwsnathwsnwsntaymtnaaytggtaycarcaraarccnggnaargc
nccnaarmtnmtnathtayacngtnwsnwsnmtncarwsnggngtnccnwsnmgnttywsnggn
wsnggnwsnggnacngayttyacnmtnacnathwsnwsnmtncarccngargayttygcnacnt
aytaytgycarcarwsntayttyacnccnathacnttyggncarggnacnmgnmtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U<sub>L</sub>-49 light chain nucleotide sequence (SEQ ID NO:567)
gayathcaratgacncarwsnccnwsnwsnmtnwsngcnwsngtnggngaymgngtnacnatha
cntgymgngcnwsncarwsnathwsnwsntaymtnaaytggtaycarcaraarccnggnaargc
nccnaarmtnmtnathtayacngtnwsnwsnmtncarwsnggngtnccnwsnmgnttywsnggn
wsnggnwsnggnacngayttyacnmtnacnathwsnwsnmtncarccngargayttygcnacnt
aytaytgycarcarwsntayttyacnccnathacnttyggncarggnacnmgnmtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

FIGURE 13P

U<sub>L</sub>-50 light chain nucleotide sequence (SEQ ID NO:567)
gayathcaratgacncarwsnccnwsnwsnmtnwsngcnwsngtnggngaymgngtnacnatha
cntgymgngcnwsncarwsnathwsnwsntaymtnaaytggtaycarcaraarccnggnaargc
nccnaarmtnmtnathtayacngtnwsnwsnmtncarwsnggngtnccnwsnmgnttywsnggn
wsnggnwsnggnacngayttyacnmtnacnathwsnwsnmtncarccngargayttygcnacnt
aytaytgycarcarwsntayttyacnccnathacnttyggncarggnacnmgnmtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U<sub>L</sub>-51 light chain nucleotide sequence (SEQ ID NO:568)
gayathcaratgacncarwsnccnwsnwsnmtnwsngcnwsngtnggngaymgngtnacnatha
cntgymgngcnwsncarwsnathwsnwsntaymtnaaytggtaycarcaraarccnggnaargc
nccnaarmtnmtnathtayacngcnwsnwsnmtncarwsnggngtnccnwsnmgnttywsnggn
wsnggnwsnggnacngayttyacnmtnacnathwsnwsnmtncarccngargayttygcnwsnt
aytaytgycarcarwsnttytaygcnccnathacnttyggncarggnacnmgnmtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U<sub>L</sub>-52 light chain nucleotide sequence (SEQ ID NO:568)
gayathcaratgacncarwsnccnwsnwsnmtnwsngcnwsngtnggngaymgngtnacnatha
cntgymgngcnwsncarwsnathwsnwsntaymtnaaytggtaycarcaraarccnggnaargc
nccnaarmtnmtnathtayacngcnwsnwsnmtncarwsnggngtnccnwsnmgnttywsnggn
wsnggnwsnggnacngayttyacnmtnacnathwsnwsnmtncarccngargayttygcnwsnt
aytaytgycarcarwsnttytaygcnccnathacnttyggncarggnacnmgnmtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

FIGURE 13Q

U$_L$-53 light chain nucleotide sequence (SEQ ID NO:569)
gayathcaratgacncarwsnccnwsnwsnmtnwsngcnwsngtnggngaymgngtnacnatha
cntgymgngcnwsncarwsnathwsnwsntaymtnaaytggtaycarcaraarccnggnaargc
nccnaarmtnmtnathtayacngcnwsnwsnmtncarwsnggngtnccnwsnmgnttywsnggn
wsnggnwsnggnacngayttyacnmtnacnathwsnwsnmtncarccngargayttygcnacnt
aytaytgycarcarwsntayttyacnccnathacnttyggncarggnacnmgnmtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U$_L$-54 light chain nucleotide sequence (SEQ ID NO:570)
gayathcaratgacncarwsnccnwsnwsnmtnwsngcnwsngtnggngaymgngtnacnatha
cntgycargcnwsncargayathwsnaaytaymtnaaytggtaycarcaraarccnggnaargc
nccnaarmtnmtnathtaygaygcnwsnaaymtngaracnggngtnccnwsnmgnttywsnggn
wsnggnwsnggnacngayttyacnttyacnathwsnwsnmtncarccngargayathgcnacnt
aytaytgycarcartaygaytaymtnccnttyacnttyggnccnggnacnaargtngayathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U$_L$-55 light chain nucleotide sequence (SEQ ID NO:570)
gayathcaratgacncarwsnccnwsnwsnmtnwsngcnwsngtnggngaymgngtnacnatha
cntgycargcnwsncargayathwsnaaytaymtnaaytggtaycarcaraarccnggnaargc
nccnaarmtnmtnathtaygaygcnwsnaaymtngaracnggngtnccnwsnmgnttywsnggn
wsnggnwsnggnacngayttyacnttyacnathwsnwsnmtncarccngargayathgcnacnt
aytaytgycarcartaygaytaymtnccnttyacnttyggnccnggnacnaargtngayathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

FIGURE 13R

U<sub>L</sub>-56 light chain nucleotide sequence (SEQ ID NO:571)
gayathcaratgacncarwsnccnwsnwsnmtnwsngcnwsngtnggngaymgngtnacnatha
cntgycargcnwsncargayathwsnaaywsnmtnaaytggtaycarcaraarccnggnaargc
nccngarmtnmtnathtaygaygcnwsnaaymtngaracnggngtnccnwsnmgnttywsnggn
wsnggnwsnggnacngayttyacnttyacnathwsnwsnmtncarccngargayathgcnacnt
aytaytgycarcartgygaygaymtnccnmtnacnttyggnggnggnacnaargtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U<sub>L</sub>-57 light chain nucleotide sequence (SEQ ID NO:572)
gayathcaratgacncarwsnccnwsnwsnmtnwsngcnwsngtnggngaymgngtnacnatha
cntgycargcnwsncargayathwsngaytaymtnaaytggtaycarcaraarccnggnaargc
nccnaarmtnmtnathtaygaygcnwsnaaymtngaracnggngtnccnwsnmgnttywsnggn
wsnggnwsnggnacngayttyacnttyacnathwsnwsnmtncarccngargayathgcnacnt
aytaytgycarcaytaygayaaymtnccnmtnacnttyggnggnggnacnaargtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U<sub>L</sub>-58 light chain nucleotide sequence (SEQ ID NO:573)
gayathcaratgacncarwsnccnwsnwsnmtnwsngcnwsngtnggngaymgngtngcnatha
cntgycargcnwsncargayathwsnaaytaymtnaaytggtaycarcaraarccnggnaargc
nccnaarmtnmtnathtaygaygcnwsnaaymtngaracnggngtnccnwsnmgnttywsnggn
wsnggnwsnggnacngayttyacnttyacnathwsnwsnmtncarccngargayathgcnacnt
aytaytgycarcartaygayaaymtnccnmtnacnttyggnggnggnacnaargtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

FIGURE 13S

U<sub>L</sub>-59 light chain nucleotide sequence (SEQ ID NO:573)
gayathcaratgacncarwsnccnwsnwsnmtnwsngcnwsngtnggngaymgngtngcnatha
cntgycargcnwsncargayathwsnaaytaymtnaaytggtaycarcaraarccnggnaargc
nccnaarmtnmtnathtaygaygcnwsnaaymtngaracnggngtnccnwsnmgnttywsnggn
wsnggnwsnggnacngayttyacnttyacnathwsnwsnmtncarccngargayathgcnacnt
aytaytgycarcartaygayaaymtnccnmtnacnttyggnggnggnacnaargtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U<sub>L</sub>-60 light chain nucleotide sequence (SEQ ID NO:574)
gayathcaratgacncarwsnccnwsnwsnmtnwsngcnwsngtnggngaymgngtnacnatha
cntgycargcnwsncargayathwsnaaywsnmtnaaytggtaycarcaraarccnggnaargc
nccnaarmtnmtnathtaygaygcnwsnathmtngaracnggngtnccnwsnmgnttywsnggn
wsnggnwsngaracngayttyacnttyacnathwsnwsnmtncarccngargayathgcnacnt
aytaytgycarcartgygayathmtnccnmtnwsnttyggnggnggnacnaargtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U<sub>L</sub>-61 light chain nucleotide sequence (SEQ ID NO:575)
gayathcaratgacncarwsnccnwsnwsnmtnwsngcnwsngtnggngaymgngtnacnatha
cntgycargcnwsncargayathwsnaaywsnmtnaaytggtaycarcaraarccnggnaargc
nccnaarmtnmtnathtaygaygcnwsnaaymtngaracnggngtnccnwsnmgnttywsnggn
wsnggnwsnggnacngayttyacnttyacnathwsnwsnmtncarccngargayathgcnacnt
aytaytgycarcartaygayaaymtnccnmtngcnttyggnggnggnacnaargtngarathmg
nmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

FIGURE 13T

U$_L$-62 light chain nucleotide sequence (SEQ ID NO:576)
gayathcaratgacncarwsnccnwsnwsnmtnwsngcnwsngtnggngayggngtnacnatha
cntgycargcnwsncargayathacnaaytaymtnaaytggtaycarcaraarccnggnaargc
nccnaarmtnmtnathtaygaygcnwsnaaymtngaracnggngtnccnwsnmgnttywsnggn
wsnggnwsnggnacngayttyacnttyacnathwsnwsnmtncarccngargayathgcnacnt
aytaytgycarcartaygaywsnmtnccnathacnttyggncarggnacnmgnmtngarathaa
rmgnacngtngcngcncnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U$_L$-63 light chain nucleotide sequence (SEQ ID NO:577)
gayathcaratgacncarwsnccnwsnwsnmtnwsngcnwsngtnggngaymgngtnacnatha
cntgycargcnwsncargayathwsnaaytaymtnaaytggtaycarcaraarmtnggnaargc
nccnaarmtnmtnathcaygaygcnwsnaaymtngaracnggngtnccnwsnmgnttywsnggn
wsnggnwsnggnacngayttyacnttyacnathwsnwsnmtncarccngargayathgcnacnt
aytaytgycarcartaygayaaymtnccnathacnttyggncarggnacnmgnmtngarathaa
rmgnacngtngcngcncnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

U$_L$-64 light chain nucleotide sequence (SEQ ID NO:578)
gayathcaratgacncarwsnccnwsnwsnmtnwsngcnwsngtnggngaymgngtnacnatha
cntgycargcnwsncargayathwsngaytaymtnaaytggtaycarcaraarccnggnaargc
nccnaarmtnmtnathtaygaygcnwsnaaymtngaracnggngtnccnwsnmgnttywsnggn
wsnggnwsnggnacngayttyacnttyacnathwsnwsnmtncarccngargayathgcnacnt
aytaytgycarcaytaygayaaymtnccnathacnttyggncarggnacnmgnmtngarathaa
rmgnacngtngcngcncnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtacngarcargaywsnaargayws
nacntaywsnmtnwsnwsnacnmtnacnmtnwsnaargcngaytaygaraarcayaargtntay
gcntgygargtnacncaycarggnmtnwsnwsnccngtnacnaarwsnttyaaymgnggngart
gy

FIGURE 13U

U<sub>L</sub>-65 light chain nucleotide sequence (SEQ ID NO:579)

```
gayathcaratgacncarwsnccnwsnwsnmtnwsngcnwsngtnggngaymgngtnacnatha
cntgycargcnwsncargayathwsnaaywsnmtnaaytggtaycarcaraarccnggnaargc
nccnaarmtnmtnathtaygaygcnwsnaaymtngaracnggngtnccnwsnmgnttywsnggn
wsnggnwsnggnacngayttyacnttyacnathwsnwsnmtncarccngargayathgcnacnt
aytaytgycarcaytaygayaaymtnccnathacnttyggncarggnacnmgnmtngarathaa
rmgnacngtngcngcnccnwsngtnttyathttyccnccnwsngaygarcarmtnaarwsnggn
acngcnwsngtngtntgymtnmtnaayaayttytayccnmgngargcnaargtncartggaarg
tngayaaygcnmtncarwsnggnaaywsncargarwsngtnacngarcargaywsnaargayws
nacntaywsnmtnwsnwsnacnmtnacnmtnwsnaargcngaytaygaraarcayaargtntay
gctgygargtnacncaycarggnmtnwsnwsnccngtnacnaarwsnttyaaymgnggngart
gy
```

FIGURE 13V

U<sub>H</sub>-1 heavy chain nucleotide sequence (SEQ ID NO:580)
cargtncarmtngtncarwsnggngcngargtnaaraarccnggngcnwsngtnaargtnwsnt
gyaargcnwsnggntayacnttyacnwsntayggnathwsntgggtnmgncargcnccnggnca
rggnmtngartggatgggntggathwsngcnwsnaayggnaayacnaaytaygcncaraarmtn
cargaymgngtnacnatgacnacngayacnwsnacnwsnacngcntayatggarmtnmgnwsnm
tnmgnwsngaygayacngcngtntaytaytgygcnmgngargayaaytggaaytayggnttytt
ygaytaytggggncarggnacnmtngtnacngtnwsnwsngcnwsnacnaarggnccnwsngtn
ttyccnmtngcnccntgywsnmgnwsnacnwsngarwsnacngcngcnmtnggntgymtngtna
argaytayttyccngarccngtnacngtnwsntggaaywsnggngcnmtnacnwsnggngtnca
yacnttyccngcngtnmtncarwsnwsnggnmtntaywsnmtnwsnwsngtngtnacngtnccn
wsnwsnaayttyggnacncaracntayacntgyaaygtngaycayaarccnwsnaayacnaarg
tngayaaracngtngarmgnaartgytgygtngartgyccnccntgyccngcnccnccngtngc
nggnccnwsngtnttymtnttyccnccnaarccnaargayacnmtnatgathwsnmgnacnccn
gargtnacntgygtngtngtngaygtnwsncaygargayccngargtncarttyaaytggtayg
tngayggngtngargtncayaaygcnaaracnaarccnmgngargarcarttyaaywsnacntt
ymgngtngtnwsngtnmtnacngtngtncaycargaytggmtnaayggnaargartayaartgy
aargtnwsnaayaarggnmtnccngcnccnathgaraaracnathwsnaaracnaarggncarc
cnmgngarccncargtntayacnmtnccnccnwsnmgngargaratgacnaaraaycargtnws
nmtnacntgymtngtnaarggnttytayccnwsngayathgcngtngartgggarwsnaayggn
carccngaraayaaytayaaracnacnccnccnatgmtngaywsngayggnwsnttyttymtnt
aywsnaarmtnacngtngayaarwsnmgntggcarcarggnaaygtnttywsntgywsngtnat
gcaygargcnmtncayaaycaytayacncaraarwsnmtnwsnmtnwsnccnggnaar U<sub>H</sub>-2 heavy chain nucleotide sequence (SEQ ID NO:580)
cargtncarmtngtncarwsnggngcngargtnaaraarccnggngcnwsngtnaargtnwsnt
gyaargcnwsnggntayacnttyacnwsntayggnathwsntgggtnmgncargcnccnggnca
rggnmtngartggatgggntggathwsngcnwsnaayggnaayacnaaytaygcncaraarmtn
cargaymgngtnacnatgacnacngayacnwsnacnwsnacngcntayatggarmtnmgnwsnm
tnmgnwsngaygayacngcngtntaytaytgygcnmgngargayaaytggaaytayggnttytt
ygaytaytggggncarggnacnmtngtnacngtnwsnwsngcnwsnacnaarggnccnwsngtn
ttyccnmtngcnccntgywsnmgnwsnacnwsngarwsnacngcngcnmtnggntgymtngtna
argaytayttyccngarccngtnacngtnwsntggaaywsnggngcnmtnacnwsnggngtnca
yacnttyccngcngtnmtncarwsnwsnggnmtntaywsnmtnwsnwsngtngtnacngtnccn
wsnwsnaayttyggnacncaracntayacntgyaaygtngaycayaarccnwsnaayacnaarg
tngayaaracngtngarmgnaartgytgygtngartgyccnccntgyccngcnccnccngtngc
nggnccnwsngtnttymtnttyccnccnaarccnaargayacnmtnatgathwsnmgnacnccn
gargtnacntgygtngtngtngaygtnwsncaygargayccngargtncarttyaaytggtayg
tngayggngtngargtncayaaygcnaaracnaarccnmgngargarcarttyaaywsnacntt
ymgngtngtnwsngtnmtnacngtngtncaycargaytggmtnaayggnaargartayaartgy
aargtnwsnaayaarggnmtnccngcnccnathgaraaracnathwsnaaracnaarggncarc
cnmgngarccncargtntayacnmtnccnccnwsnmgngargaratgacnaaraaycargtnws
nmtnacntgymtngtnaarggnttytayccnwsngayathgcngtngartgggarwsnaayggn
carccngaraayaaytayaaracnacnccnccnatgmtngaywsngayggnwsnttyttymtnt
aywsnaarmtnacngtngayaarwsnmgntggcarcarggnaaygtnttywsntgywsngtnat
gcaygargcnmtncayaaycaytayacncaraarwsnmtnwsnmtnwsnccnggnaar

FIGURE 14A

U<sub>H</sub>-3 heavy chain nucleotide sequence (SEQ ID NO:581)
cargtncaymtngtncarwsnggngcngargtnaaraarccnggngcnwsngtnaargtnwsnt
gyaargtnwsnggntayacnttyacnggncaytayatgcaytgggtnmgncargcnccnggnca
rggnmtngartggatgggntggathaayccnaaywsnggnggnacnaaytgygcncaraartty
carggnmgngtnacnatgacnmgngayacnwsnathwsnacngcntayatggarmtnwsnmgnm
tnmgnwsngaygayacngcngtntaytaytgygcnmgnwsnathgcngtngcnmtngaytaytg
gggncarggnacnmtngtnacngtnwsnwsngcnwsnacnaarggnccnwsngtnttyccnmtn
gcnccntgywsnmgnwsnacnwsngarwsnacngcngcnmtnggntgymtngtnaargaytayt
tyccngarccngtnacngtnwsntggaaywsnggngcnmtnacnwsnggngtncayacnttycc
ngcngtnmtncarwsnwsnggnmtntaywsnmtnwsnwsngtngtnacngtnccnwsnwsnaay
ttyggnacncaracntayacntgyaaygtngaycayaarccnwsnaayacnaargtngayaara
cngtngarmgnaartgytgygtngartgyccnccntgyccngcnccncngtngcnggnccnws
ngtnttymtnttyccnccnaarccnaargayacnmtnatgathwsnmgnacnccngargtnacn
tgygtngtngtngaygtnwsncaygargayccngargtncarttyaaytggtaygtngayggng
tngargtncayaaygcnaaracnaarccnmgngargarcarttyaaywsnacnttymgngtngt
nwsngtnmtnacngtngtncaycargaytggmtnaayggnaargartayaartgyaargtnwsn
aayaarggnmtnccngcnccnathgaraaracnathwsnaaracnaarggncarccnmgngarc
cncargtntayacnmtnccnccnwsnmgngargaratgacnaaraaycargtnwsnmtnacntg
ymtngtnaarggnttytayccnwsngayathgcngtngartgggarwsnaayggncarccngar
aayaaytayaaracnacnccnccnatgmtngaywsngayggnwsnttyttymtntaywsnaarm
tnacngtngayaarwsnmgntggcarcarggnaaygtnttywsntgywsngtnatgcaygargc
nmtncayaaycaytayacncaraarwsnmtnwsnmtnwsnccnggnaar U<sub>H</sub>-4 heavy chain nucleotide sequence (SEQ ID NO:582)
cargtncarmtngtncarwsnggngcngargtnaaraarccnggngcnwsngtnaargtnwsnt
gyaargcnwsnggntayacnttyacnggntaytayatgcaytgggtnmgncargcnccnggnca
rggnmtngartggatgggntggathaayccnaaywsnggnggnacnaaycayacncaraartty
carggnmgngtnacnatgacnmgngayacnwsnathwsnacngcntayatggarmtnwsnmgnm
tnmgnwsngaygayacngcngtntaytaytgygcnmgnwsnathgcngtngcnmtngaytaytg
gggncarggnacnmtngtnacngtnwsnwsngcnwsnacnaarggnccnwsngtnttyccnmtn
gcnccntgywsnmgnwsnacnwsngarwsnacngcngcnmtnggntgymtngtnaargaytayt
tyccngarccngtnacngtnwsntggaaywsnggngcnmtnacnwsnggngtncayacnttycc
ngcngtnmtncarwsnwsnggnmtntaywsnmtnwsnwsngtngtnacngtnccnwsnwsnaay
ttyggnacncaracntayacntgyaaygtngaycayaarccnwsnaayacnaargtngayaara
cngtngarmgnaartgytgygtngartgyccnccntgyccngcnccncngtngcnggnccnws
ngtnttymtnttyccnccnaarccnaargayacnmtnatgathwsnmgnacnccngargtnacn
tgygtngtngtngaygtnwsncaygargayccngargtncarttyaaytggtaygtngayggng
tngargtncayaaygcnaaracnaarccnmgngargarcarttyaaywsnacnttymgngtngt
nwsngtnmtnacngtngtncaycargaytggmtnaayggnaargartayaartgyaargtnwsn
aayaarggnmtnccngcnccnathgaraaracnathwsnaaracnaarggncarccnmgngarc
cncargtntayacnmtnccnccnwsnmgngargaratgacnaaraaycargtnwsnmtnacntg
ymtngtnaarggnttytayccnwsngayathgcngtngartgggarwsnaayggncarccngar
aayaaytayaaracnacnccnccnatgmtngaywsngayggnwsnttyttymtntaywsnaarm
tnacngtngayaarwsnmgntggcarcarggnaaygtnttywsntgywsngtnatgcaygargc
nmtncayaaycaytayacncaraarwsnmtnwsnmtnwsnccnggnaar

FIGURE 14B

U<sub>H</sub>-5 heavy chain nucleotide sequence (SEQ ID NO:583)
cargtncarmtngtncarwsnggngcngargtnmgnaarccnggngcnwsngtnaargtnwsnt
gyaargtnwsnggntayacnmtnacngarmtnwsnatgcaytgggtnmgncargcnccnggnaa
rggnmtngartggatgggnwsnttygayccngargayggngaracnathtaygcncaraartty
carggnmgngtnacnatgmtngargayacnwsnacngayacngcntayatggarmtnwsnwsnm
tnmgnwsngargayacngcngtntaytaytgygcnacngarggngayggnggntaytaytayta
yggnatggaygtntggggncarggnacnacngtnacngtnwsnwsngcnwsnacnaarggnccn
wsngtnttyccnmtngcnccntgywsnmgnwsnacnwsngarwsnacngcngcnmtnggntgym
tngtnaargaytayttyccngarccngtnacgtnwsntggaaywsnggngcnmtnacnwsngg
ngtncayacnttyccngcngtnmtncarwsnwsnggnmtntaywsnmtnwsnwsngtngtnacn
gtnccnwsnwsnaayttyggnacncaracntayacntgyaaygtngaycayaarccnwsnaaya
cnaargtngayaaracngtngarmgnaartgytgygtngartgyccnccntgyccngcnccncc
ngtngcnggnccnwsngtnttymtnttyccnccnaarccnaargayacnmtnatgathwsnmgn
acnccngargtnacntgygtngtngtngaygtnwsncaygargayccngargtncarttyaayt
ggtaygtngayggngtngargtncayaaygcnaaracnaarccnmgngargarcarttyaayws
nacnttymgngtngtnwsngtnmtnacngtngtncaycargaytggmtnaayggnaargartay
aartgyaargtnwsnaayaarggnmtnccngcnccnathgaraaracnathwsnaaracnaarg
gncarccnmgngarccncargtntayacnmtnccnccnwsnmgngargaratgacnaaraayca
rgtnwsnmtnacntgymtngtnaarggnttytayccnwsngayathgcngtngartgggarwsn
aayggncarccngaraayaaytayaaracnacnccnccnatgmtngaywsngayggnwsnttyt
tymtntaywsnaarmtnacngtngayaarwsnmgntggcarcarggnaaygtnttywsntgyws
ngtnatgcaygargcnmtncayaaycaytayacncaraarwsnmtnwsnmtnwsnccnggnaar U<sub>H</sub>-6 heavy chain nucleotide sequence (SEQ ID NO:583)
cargtncarmtngtncarwsnggngcngargtnmgnaarccnggngcnwsngtnaargtnwsnt
gyaargtnwsnggntayacnmtnacngarmtnwsnatgcaytgggtnmgncargcnccnggnaa
rggnmtngartggatgggnwsnttygayccngargayggngaracnathtaygcncaraartty
carggnmgngtnacnatgmtngargayacnwsnacngayacngcntayatggarmtnwsnwsnm
tnmgnwsngargayacngcngtntaytaytgygcnacngarggngayggnggntaytaytayta
yggnatggaygtntggggncarggnacnacngtnacngtnwsnwsngcnwsnacnaarggnccn
wsngtnttyccnmtngcnccntgywsnmgnwsnacnwsngarwsnacngcngcnmtnggntgym
tngtnaargaytayttyccngarccngtnacgtnwsntggaaywsnggngcnmtnacnwsngg
ngtncayacnttyccngcngtnmtncarwsnwsnggnmtntaywsnmtnwsnwsngtngtnacn
gtnccnwsnwsnaayttyggnacncaracntayacntgyaaygtngaycayaarccnwsnaaya
cnaargtngayaaracngtngarmgnaartgytgygtngartgyccnccntgyccngcnccncc
ngtngcnggnccnwsngtnttymtnttyccnccnaarccnaargayacnmtnatgathwsnmgn
acnccngargtnacntgygtngtngtngaygtnwsncaygargayccngargtncarttyaayt
ggtaygtngayggngtngargtncayaaygcnaaracnaarccnmgngargarcarttyaayws
nacnttymgngtngtnwsngtnmtnacngtngtncaycargaytggmtnaayggnaargartay
aartgyaargtnwsnaayaarggnmtnccngcnccnathgaraaracnathwsnaaracnaarg
gncarccnmgngarccncargtntayacnmtnccnccnwsnmgngargaratgacnaaraayca
rgtnwsnmtnacntgymtngtnaarggnttytayccnwsngayathgcngtngartgggarwsn
aayggncarccngaraayaaytayaaracnacnccnccnatgmtngaywsngayggnwsnttyt
tymtntaywsnaarmtnacngtngayaarwsnmgntggcarcarggnaaygtnttywsntgyws
ngtnatgcaygargcnmtncayaaycaytayacncaraarwsnmtnwsnmtnwsnccnggnaar

FIGURE 14C

U<sub>H</sub>-7 heavy chain nucleotide sequence (SEQ ID NO:584)
cargtnacnmtnaargarwsnggnccngtnmtngtnaarccnacngaracnmtnacnmtnacnt
gyacngtnwsnggnttywsnmtnwsnaaygcnmgnatgggngtnwsntggathmgncarccncc
nggnaargcnmtngartggmtngcncayathttywsnaaygaygaraarwsntaywsnacnwsn
mtnaarwsnmgnmtnacnathwsnaargayacnwsnaarwsncargtngtnmtnacnatgacna
ayatggayccngtngayacngcnacntaytaytgygcnmgnatgtaywsnwsnggntggtaygg
ngtnttygaytaytggggncarggnacnmtngtnacngtnwsnwsngcnwsnacnaarggnccn
wsngtnttyccnmtngcnccntgywsnmgnwsnacnwsngarwsnacngcngcnmtnggntgym
tngtnaargaytayttyccngarccngtnacgtnwsntggaaywsnggngcnmtnacnwsngg
ngtncayacnttyccngcngtnmtncarwsnwsnggnmtntaywsnmtnwsnwsngtngtnacn
gtnccnwsnwsnaayttyggnacncaracntayacntgyaaygtngaycayaarccnwsnaaya
cnaargtngayaaracngtngarmgnaartgytgygtngartgyccnccntgyccngcnccncc
ngtngcnggnccnwsngtnttymtnttyccnccnaarccnaargayacnmtnatgathwsnmgn
acnccngargtnacntgygtngtngtngaygtnwsncaygargayccngargtncarttyaayt
ggtaygtngayggngtngargtncayaaygcnaaracnaarccnmgngargarcarttyaayws
nacnttymgngtngtnwsngtnmtnacngtngtncaycargaytggmtnaayggnaargartay
aartgyaargtnwsnaayaarggnmtnccngcnccathgaraaracnathwsnaaracnaarg
gncarccnmgngarccncargtntayacnmtnccnccnwsnmgngargaratgacnaaraayca
rgtnwsnmtnacntgymtngtnaarggnttytayccnwsngayathgcngtngartgggarwsn
aayggncarccngaraayaaytayaaracnacnccnccnatgmtngaywsngayggnwsnttyt
tymtntaywsnaarmtnacngtngayaarwsnmgntggcarcarggnaaygtnttywsntgyws
ngtnatgcaygargcnmtncayaaycaytayacncaraarwsnmtnwsnmtnwsnccnggnaar U<sub>H</sub>-8 heavy chain nucleotide sequence (SEQ ID NO:585)
cargtnacnmtnaargarwsnggnccngtnmtngtnaarccnacngaracnmtnacnmtnacnt
gyacngtnwsnggnttywsnmtnwsnaaygcnmgnatgggngtnwsntggathmgncarccncc
nggnaargcnmtngartggmtngtnmtnathttywsnaaygaygaraarwsntaywsnacnwsn
mtnaarwsnmgnmtnacnathwsnaargayacnwsnaarwsncargtngtnmtnacnatgacna
ayatggayccngtngayacngcnacntaytaytgygcnmgngtntaywsnwsnggntggwsntt
ytayggnatggaygtntggggncarggnacnacngtnacngtnwsnwsngcnwsnacnaarggn
ccnwsngtnttyccnmtngcnccntgywsnmgnwsnacnwsngarwsnacgcngcnmtnggnt
gymtngtnaargaytayttyccngarccngtnacgtnwsntggaaywsnggngcnmtnacnws
nggngtncayacnttyccngcngtnmtncarwsnwsnggnmtntaywsnmtnwsnwsngtngtn
acngtnccnwsnwsnaayttyggnacncaracntayacntgyaaygtngaycayaarccnwsna
ayacnaargtngayaaracngtngarmgnaartgytgygtngartgyccnccntgyccngcncc
nccngtngcnggnccnwsngtnttymtnttyccnccnaarccnaargayacnmtnatgathwsn
mgnacnccngargtnacntgygtngtngtngaygtnwsncaygargayccngargtncarttya
aytggtaygtngayggngtngargtncayaaygcnaaracnaarccnmgngargarcarttyaa
ywsnacnttymgngtngtnwsngtnmtnacngtngtncaycargaytggmtnaayggnaargar
tayaartgyaargtnwsnaayaarggnmtnccngcnccathgaraaracnathwsnaaracna
arggncarccnmgngarccncargtntayacnmtnccnccnwsnmgngargaratgacnaaraa
ycargtnwsnmtnacntgymtngtnaarggnttytayccnwsngayathgcngtngartgggar
wsnaayggncarccngaraayaaytayaaracnacnccnccnatgmtngaywsngayggnwsnt
tyttymtntaywsnaarmtnacngtngayaarwsnmgntggcarcarggnaaygtnttywsntg
ywsngtnatgcaygargcnmtncayaaycaytayacncaraarwsnmtnwsnmtnwsnccnggn
aar

FIGURE 14D

U<sub>H</sub>-9 heavy chain nucleotide sequence (SEQ ID NO:586)
carathacnmtnaargarwsnggnccnacnmtngtnaarccnacncaracnmtnacnmtnacnt
gyacnttywsnggnttywsnmtnwsnacnggnggngtnggngtnggntggathmgncarccnc
nggnaargcnmtngartggmtngcnmtnathtaytggaaygaygayaarmgntaywsnccnwsn
mtnaarwsnmgnmtnacnathacnaargayacnwsnaaraaycargtngtnmtnacnatgacna
ayatggayccngtngayacngcnacntaytaytgygcncaymgnmgnarmtnccnttygayta
ytggggncarggnacnmtngtnacngtnwsnwsngcnwsnacnaarggnccnwsngtnttyccn
mtngcnccntgywsnmgnwsnacnwsngarwsnacngcngcnmtnggntgymtngtnaargayt
ayttyccngarccngtnacngtnwsntggaaywsnggngcnmtnacnwsnggngtncayacntt
yccngcngtnmtncarwsnwsnggnmtntaywsnmtnwsnwsngtngtnacngtnccnwsnwsn
aayttyggnacncaracntayacntgyaaygtngaycayaarccnwsnaayacnaargtngaya
aracngtngarmgnaartgytgygtngartgyccnccntgyccngcnccncngtngcnggnccn
nwsngtnttymtnttyccnccaarccnaargayacnmtnatgathwsnmgnacnccngargtn
acntgygtngtngtngaygtnwsncaygargayccngargtncarttyaaytggtaygtngayg
gngtngargtncayaaygcnaaracnaarccnmgngargarcarttyaaywsnacnttymgngt
ngtnwsngtnmtnacngtngtncaycargaytggmtnaayggnaargartayaartgyaargtn
wsnaayaarggnmtnccngcnccnathgaraaracnathwsnaaracnaarggncarccnmgng
arccncargtntayacnmtnccnccnwsnmgngargaratgacnaaraaycargtnwsnmtnac
ntgymtngtnaarggnttytayccnwsngayathgcngtngartgggarwsnaayggncarccn
garaayaaytayaaracnacnccnccnatgmtngaywsngayggnwsnttyttymtntaywsna
armtnacngtngayaarwsnmgntggcarcarggnaaygtnttywsntgywsngtnatgcayga
rgcnmtncayaaycaytayacncaraarwsnmtnwsnmtnwsnccnggnaar U<sub>H</sub>-10 heavy chain nucleotide sequence (SEQ ID NO:587)
carathacnmtnaargarwsnggnccnacnmtngtnaarccnacncaracnmtnacnmtnacnt
gyacnttywsnggnttywsnmtnwsnacnggnggngtnggngtnggntggathmgncarccnc
nggnaargcnmtngartggmtngcnmtnathtaytggaaygaygayaarmgntaywsnccnwsn
mtnaarwsnmgnmtnacnathacnaargayacnwsnaaracncargtngtnmtnacngtnacng
ayatggayccngtngayacngcnacntaytaytgygcncaymgnaaytggacnccnttygayta
ytggggncarggnacnmtngtnacngtnwsnwsngcnwsnacnaarggnccnwsngtnttyccn
mtngcnccntgywsnmgnwsnacnwsngarwsnacngcngcnmtnggntgymtngtnaargayt
ayttyccngarccngtnacngtnwsntggaaywsnggngcnmtnacnwsnggngtncayacntt
yccngcngtnmtncarwsnwsnggnmtntaywsnmtnwsnwsngtngtnacngtnccnwsnwsn
aayttyggnacncaracntayacntgyaaygtngaycayaarccnwsnaayacnaargtngaya
aracngtngarmgnaartgytgygtngartgyccnccntgyccngcnccncngtngcnggnccn
nwsngtnttymtnttyccnccaarccnaargayacnmtnatgathwsnmgnacnccngargtn
acntgygtngtngtngaygtnwsncaygargayccngargtncarttyaaytggtaygtngayg
gngtngargtncayaaygcnaaracnaarccnmgngargarcarttyaaywsnacnttymgngt
ngtnwsngtnmtnacngtngtncaycargaytggmtnaayggnaargartayaartgyaargtn
wsnaayaarggnmtnccngcnccnathgaraaracnathwsnaaracnaarggncarccnmgng
arccncargtntayacnmtnccnccnwsnmgngargaratgacnaaraaycargtnwsnmtnac
ntgymtngtnaarggnttytayccnwsngayathgcngtngartgggarwsnaayggncarccn
garaayaaytayaaracnacnccnccnatgmtngaywsngayggnwsnttyttymtntaywsna
armtnacngtngayaarwsnmgntggcarcarggnaaygtnttywsntgywsngtnatgcayga
rgcnmtncayaaycaytayacncaraarwsnmtnwsnmtnwsnccnggnaar

FIGURE 14E

U<sub>H</sub>-11 heavy chain nucleotide sequence (SEQ ID NO:588)

carathacnmtnaargarwsnggnccnacnmtngtnaarccnacncaracnmtnacnmtnacnt
gyacnttywsnggnttywsnmtnaayacnggnggngtnggngtnggntggathmgncarccnc
nggnaargcnmtngartggmtngcnmtnathtaytggaaygaygayaarmgntaywsnccnwsn
mtnaarwsnmgnmtnacnathacnaargayacnwsnaaraaycargtngtnmtnacnatgacna
ayatggayccngtngayacngcnacntaytaytgygcncaymgnmtngarmtnccnttygayta
ytggggncarggnacnmtngtnacngtnwsnwsngcnwsnacnaarggnccnwsngtnttyccn
mtngcnccntgywsnmgnwsnacnwsngarwsnacngcngcnmtnggntgymtngtnaargayt
ayttyccngarccngtnacngtnwsntggaaywsnggngcnmtnacnwsnggngtncayacntt
yccngcngtnmtncarwsnwsnggnmtntaywsnmtnwsnwsngtngtnacngtnccnwsnwsn
aayttyggnacncaracntayacntgyaaygtngaycayaarccnwsnaayacnaargtngaya
aracngtngarmgnaartgytgygtngartgyccnccntgyccngcnccnccngtngcnggncc
nwsngtnttymtnttyccnccnaarccnaargayacnmtnatgathwsnmgnacnccngargtn
acntgygtngtngtngaygtnwsncaygargayccngargtncarttyaaytggtaygtngayg
gngtngargtncayaaygcnaaracnaarccnmgngargarcarttyaaywsnacnttymgngt
ngtnwsngtnmtnacngtngtncaycargaytggmtnaayggnaargartayaartgyaargtn
wsnaayaarggnmtnccngcnccnathgaraaracnathwsnaaracnaarggncarccnmgng
arccncargtntayacnmtnccnccnwsnmgngargaratgacnaaraaycargtnwsnmtnac
ntgymtngtnaarggnttytayccnwsngayathgcngtngartgggarwsnaayggncarccn
garaayaaytayaaracnacnccnccnatgmtngaywsngayggnwsnttyttymtntaywsna
armtnacngtngayaarwsnmgntggcarcarggnaaygtnttywsntgywsngtnatgcayga
rgcnmtncayaaycaytayacncaraarwsnmtnwsnmtnwsnccnggnaar

U<sub>H</sub>-12 heavy chain nucleotide sequence (SEQ ID NO:589)

carathacnmtnaargarwsnggnccnacnmtngtnaarccnacncaracnmtnacnmtnacnt
gyacnttywsnggnttywsnmtnwsnacngggnggngtnggngtnggntggathmgncarccnc
nggnaargcnmtngartggmtngcnmtnathtaytggaaygaygayaarmgntaywsnccnwsn
mtnaarwsnmgnmtnacnathacnaargayacnwsnaaraaycargtngtnmtnacnatgacna
aymtngayccngtngayacngcnacntaytaytgygcncaymgnmgngargtnccnttygayta
ytggggncarggnacnmtngtnacngtnwsnwsngcnwsnacnaarggnccnwsngtnttyccn
mtngcnccntgywsnmgnwsnacnwsngarwsnacngcngcnmtnggntgymtngtnaargayt
ayttyccngarccngtnacngtnwsntggaaywsnggngcnmtnacnwsnggngtncayacntt
yccngcngtnmtncarwsnwsnggnmtntaywsnmtnwsnwsngtngtnacngtnccnwsnwsn
aayttyggnacncaracntayacntgyaaygtngaycayaarccnwsnaayacnaargtngaya
aracngtngarmgnaartgytgygtngartgyccnccntgyccngcnccnccngtngcnggncc
nwsngtnttymtnttyccnccnaarccnaargayacnmtnatgathwsnmgnacnccngargtn
acntgygtngtngtngaygtnwsncaygargayccngargtncarttyaaytggtaygtngayg
gngtngargtncayaaygcnaaracnaarccnmgngargarcarttyaaywsnacnttymgngt
ngtnwsngtnmtnacngtngtncaycargaytggmtnaayggnaargartayaartgyaargtn
wsnaayaarggnmtnccngcnccnathgaraaracnathwsnaaracnaarggncarccnmgng
arccncargtntayacnmtnccnccnwsnmgngargaratgacnaaraaycargtnwsnmtnac
ntgymtngtnaarggnttytayccnwsngayathgcngtngartgggarwsnaayggncarccn
garaayaaytayaaracnacnccnccnatgmtngaywsngayggnwsnttyttymtntaywsna
armtnacngtngayaarwsnmgntggcarcarggnaaygtnttywsntgywsngtnatgcayga
rgcnmtncayaaycaytayacncaraarwsnmtnwsnmtnwsnccnggnaar

FIGURE 14F

U<sub>H</sub>-13 heavy chain nucleotide sequence (SEQ ID NO:590)
carathacnmtnaargarwsnggnccnacnmtngtnaarccnacncaracnmtnacnmtnacnt
gyacnttywsnggnttywsnmtnwsnacngggnggngtnggngtnggntggathmgncarccnc
nggnaargcnmtngartggmtngcnmtnathtaytggaaygtngaraarmgntaywsnccnwsn
mtnmgnwsnmgnmtnacnathacnaargcnacwsnaaraaycargtngtnmtnacnatgacna
ayatggayccngtngayacngcnacntaytaytgygcncaymgncayacnaayccnttygarta
ytggggncarggnacnmtngtnacngtnwsnwsngcnwsnacnaarggnccnwsngtnttyccn
mtngcnccntgywsnmgnwsnacnwsngarwsnacngcngcnmtnggntgymtngtnaargayt
ayttyccngarccngtnacngtnwsntggaaywsnggngcnmtnacnwsnggngtncayacntt
yccgcngtnmtncarwsnwsnggnmtntaywsnmtnwsnwsngtngtnacngtnccnwsnwsn
aayttyggnacncaracntayacntgyaaygtngaycayaarccnwsnaayacnaargtngaya
aracngtngarmgnaartgytgygtngartgyccnccntgyccgcnccnccgtngcnggncc
nwsngtnttymtnttyccnccaarccnaargayacnmtnatgathwsnmgnacnccgargtn
acntgygtngtngtngaygtnwsncaygargayccngargtncarttyaaytggtaygtngayg
gngtngargtncayaaygcnaaracnaarccnmgngargarcarttyaaywsnacnttymgngt
ngtnwsngtnmtnacngtngtncaycargaytggmtnaayggnaargartayaartgyaargtn
wsnaayaarggnmtnccngcnccnathgaraaracnathwsnaaracnaarggncarccnmgng
arccncargtntayacnmtnccnccnwsnmgngargaratgacnaaraaycargtnwsnmtnac
ntgymtngtnaarggnttytayccnwsngayathgcngtngartgggarwsnaayggncarccn
garaayaaytayaaracnacnccnccnatgmtngaywsngayggnwsnttyttymtntaywsna
armtnacngtngayaarwsnmgntggcarcarggnaaygtnttywsntgywsngtnatgcayga
rgcnmtncayaaycaytayacncaraarwsnmtnwsnmtnwsnccnggnaar U<sub>H</sub>-14 heavy chain nucleotide sequence (SEQ ID NO:591)
carathacnmtnaargarwsnggnccnacnmtngtnaarccnacncaracnmtnacnmtnacnt
gyacnttywsnggnttywsnmtnwsnacngggnggngtnggngtnggntggathmgncarccnc
nggnaargcnmtngartggmtngcnmtnathtaytggaaygaygayaarmgntaywsnccnwsn
mtnaarwsnmgnmtnacnathacnaargayacnwsnaaraaycargtngtnmtnacnatgacna
ayatggayccngtngayacngcnacntaytaytgygcncaymgnggngarmtnccnttygayta
ytggggncarggnacnmtngtnacngtnwsnwsngcnwsnacnaarggnccnwsngtnttyccn
mtngcnccntgywsnmgnwsnacnwsngarwsnacngcngcnmtnggntgymtngtnaargayt
ayttyccngarccngtnacngtnwsntggaaywsnggngcnmtnacnwsnggngtncayacntt
yccgcngtnmtncarwsnwsnggnmtntaywsnmtnwsnwsngtngtnacngtnccnwsnwsn
aayttyggnacncaracntayacntgyaaygtngaycayaarccnwsnaayacnaargtngaya
aracngtngarmgnaartgytgygtngartgyccnccntgyccgcnccnccgtngcnggncc
nwsngtnttymtnttyccnccaarccnaargayacnmtnatgathwsnmgnacnccgargtn
acntgygtngtngtngaygtnwsncaygargayccngargtncarttyaaytggtaygtngayg
gngtngargtncayaaygcnaaracnaarccnmgngargarcarttyaaywsnacnttymgngt
ngtnwsngtnmtnacngtngtncaycargaytggmtnaayggnaargartayaartgyaargtn
wsnaayaarggnmtnccngcnccnathgaraaracnathwsnaaracnaarggncarccnmgng
arccncargtntayacnmtnccnccnwsnmgngargaratgacnaaraaycargtnwsnmtnac
ntgymtngtnaarggnttytayccnwsngayathgcngtngartgggarwsnaayggncarccn
garaayaaytayaaracnacnccnccnatgmtngaywsngayggnwsnttyttymtntaywsna
armtnacngtngayaarwsnmgntggcarcarggnaaygtnttywsntgywsngtnatgcayga
rgcnmtncayaaycaytayacncaraarwsnmtnwsnmtnwsnccnggnaar

FIGURE 14G

UH-15 heavy chain nucleotide sequence (SEQ ID NO:591)
carathacnmtnaargarwsnggnccnacnmtngtnaarccnacncaracnmtnacnmtnacnt
gyacnttywsnggnttywsnmtnwsnacnggnggngtnggngtnggntggathmgncarccnc
nggnaargcnmtngartggmtngcnmtnathtaytggaaygaygayaarmgntaywsnccnwsn
mtnaarwsnmgnmtnacnathacnaargayacnwsnaaraaycargtngtnmtnacnatgacna
ayatggayccngtngayacngcnacntaytaytgygcncaymgnggngarmtnccnttygayta
ytggggncarggnacnmtngtnacngtnwsnwsngcnwsnacnaarggnccnwsngtnttyccn
mtngcnccntgywsnmgnwsnacnwsngarwsnacngcngcnmtnggntgymtngtnaargayt
ayttyccngarccngtnacngtnwsntggaaywsnggngcnmtnacnwsnggngtncayacntt
yccngcngtnmtncarwsnwsnggnmtntaywsnmtnwsnwsngtngtnacngtnccnwsnwsn
aayttyggnacncaracntayacntgyaaygtngaycayaarccnwsnaayacnaargtngaya
aracngtngarmgnaartgytgygtngartgyccnccntgyccngcnccnccgtngcnggncc
nwsngtnttymtnttyccnccnaarccnaargayacnmtnatgathwsnmgnacnccngargtn
acntgygtngtngtngaygtnwsncaygargayccngargtncarttyaaytggtaygtngayg
gngtngargtncayaaygcnaaracnaarccnmgngargarcarttyaaywsnacnttymgngt
ngtnwsngtnmtnacngtngtncaycargaytggmtnaayggnaargartayaartgyaargtn
wsnaayaarggnmtnccngcnccnathgaraaracnathwsnaaracnaarggncarccnmgng
arccncargtntayacnmtnccnccnwsnmgngargaratgacnaaraaycargtnwsnmtnac
ntgymtngtnaarggnttytayccnwsngayathgcngtngartgggarwsnaayggncarccn
garaayaaytayaaracnacnccnccnatgmtngaywsngayggnwsnttyttymtntaywsna
armtnacngtngayaarwsnmgntggcarcarggnaaygtnttywsntgywsngtnatgcayga
rgcnmtncayaaycaytayacncaraarwsnmtnwsnmtnwsnccnggnaar U<sub>H</sub>-16 heavy chain nucleotide sequence (SEQ ID NO:592)
gargtncarmtngtngarwsnggnggnggnmtngtnaarccnggnggnwsnmtnmgnmtnwsnt
gygcngcnwsnggnttyccnttywsnmgntaywsnatgaaytgggtnmgncargcnccnggnaa
rggnmtngartgggtnwsngcnathwsnwsnwsnwsnwsntayathtaytaygcngaywsngtn
aarggnmgnttyacnathwsnmgngayaaygcnaaraaywsnmtntaymtncaratgaaywsnm
tnmgngcngargayacngcngtntaytaytgygcnmgngaymgngtnggngcnacnccngaygc
nttygayathtggggncarggnacnatggtnacngtnwsnwsngcnwsnacnaarggnccnwsn
gtnttyccnmtngcnccntgywsnmgnwsnacnwsngarwsnacngcngcnmtnggntgymtng
tnaargaytayttyccngarccngtnacngtnwsntggaaywsnggngcnmtnacnwsnggngt
ncayacttyccngcngtnmtncarwsnwsnggnmtntaywsnmtnwsnwsngtngtnacngtn
ccnwsnwsnaayttyggnacncaracntayacntgyaaygtngaycayaarccnwsnaayacna
argtngayaaracngtngarmgnaartgytgygtngartgyccnccntgyccngcnccnccgt
ngcnggnccnwsngtnttymtnttyccnccnaarccnaargayacnmtnatgathwsnmgnacn
ccngargtnacntgygtngtngtngaygtnwsncaygargayccngargtncarttyaaytggt
aygtngayggngtngargtncayaaygcnaaracnaarccnmgngargarcarttyaaywsnac
nttymgngtngtnwsngtnmtnacngtngtncaycargaytggmtnaayggnaargartayaar
tgyaargtnwsnaayaarggnmtnccngcnccnathgaraaracnathwsnaaracnaarggnc
arccnmgngarccncargtntayacnmtnccnccnwsnmgngargaratgacnaaraaycargt
nwsnmtnacntgymtngtnaarggnttytayccnwsngayathgcngtngartgggarwsnaay
ggncarccngaraayaaytayaaracnacnccnccnatgmtngaywsngayggnwsnttyttym
tntaywsnaarmtnacngtngayaarwsnmgntggcarcarggnaaygtnttywsntgywsngt
natgcaygargcnmtncayaaycaytayacncaraarwsnmtnwsnmtnwsnccnggnaar

FIGURE 14H

U<sub>B</sub>-17 heavy chain nucleotide sequence (SEQ ID NO:593)
gargtncarmtnmtngarwsnggnggnggnmtngtncarccnggnggnwsnmtnmgnmtnwsnt
gygcngcnwsnggnttyacnttywsnwsntaygcnatgaaytgggtnmgncargcnccnggnaa
rggnmtngartgggtnwsngcnathwsnggnwsnggnggnwsnacntaytaygcngaywsngtn
aarggnmgnttyacnathwsnmgngayaaywsnaaraayacnmtntaymtncaratgaaywsnm
tnmgngcngargayacngcngtntaytaytgygcnaargarggnathgcngtngcnggnacngc
ngartaytaytaytaygcnatggaygtntggggncarggnacnacngtacngtnwsnwsn
gcnwsnacnaarggnccnwsngtnttyccnmtngcnccntgywsnmgnwsnacnwsngarwsna
cngcngcnmtggntgymtngtnaargaytayttyccngarccngtnacngtnwsntggaayws
nggngcnmtnacnwsnggngtncayacnttyccngcngtnmtncarwsnwsnggnmtntaywsn
mtnwsnwsngtngtnacngtnccnwsnwsnaayttyggnacncaracntayacntgyaaygtng
aycayaarccnwsnaayacnaargtngayaaracngtngarmgnaartgytgygtngartgycc
nccntgyccngcnccnccngtngcnggnccnwsngtnttymtnttyccnccaarccnaargay
acnmtnatgathwsnmgnacnccngargtnacntgygtngtngtngaygtnwsncaygargayc
cngargtncarttyaaytggtaygtngayggngtngargtncayaaygcnaaracnaarccnmg
ngargarcarttyaaywsnacnttymgngtngtnwsngtnmtnacngtngtncaycargaytgg
mtnaayggnaargartayaartgyaargtnwsnaayaarggnmtnccngcnccnathgaraara
cnathwsnaaracnaarggncarccnmgngarccncargtntayacnmtnccnccnwsnmgnga
rgaratgacnaaraaycargtnwsnmtnacntgymtngtnaarggnttytayccnwsngayath
gcngtngartgggarwsnaayggncarccngaraayaaytayaaracnacnccnccnatgmtng
aywsngayggnwsnttyttymtntaywsnaarmtnacngtngayaarwsnmgntggcarcargg
naaygtnttywsntgywsngtnatgcaygargcnmtncayaaycaytayacncaraarwsnmtn
wsnmtnwsnccnggnaar U<sub>B</sub>-18 heavy chain nucleotide sequence (SEQ ID NO:594)
gargtncarmtnmtngarwsnggnggnggnmtngtncarccnggnggnwsnmtnmgnmtnwsnt
gygcngcnwsnggnttyacnttywsnwsntaygcnatgwsntgggtnmgncargcnccnggnaa
rggnmtngartgggtnwsngcnathwsnggnwsnggnggnwsnacntaytaygcngaywsngtn
aarggnmgnttyacnathwsnmgngayaaywsnaaraayacnmtntaymtncaratgaaywsnm
tnmgngcngargayacngcngtntaytaytgygcnaargarggnathgcngcnmgngaywsnta
ytaytaytaygcnatggaygtntggggncarggnacnacngtacngtnwsnwsngcnwsnacn
aarggnccnwsngtnttyccnmtngcnccntgywsnmgnwsnacnwsngarwsnacngcngcnm
tnggntgymtngtnaargaytayttyccngarccngtnacngtnwsntggaaywsnggngcnmt
nacnwsnggngtncayacnttyccngcngtnmtncarwsnwsnggnmtntaywsnmtnwsnwsn
gtngtnacngtnccnwsnwsnaayttyggnacncaracntayacntgyaaygtngaycayaarc
cnwsnaayacnaargtngayaaracngtngarmgnaartgytgygtngartgyccnccntgyc
ngcnccnccngtngcnggnccnwsngtnttymtnttyccnccaarccnaargayacnmtnatg
athwsnmgnacnccngargtnacntgygtngtngtngaygtnwsncaygargayccngargtnc
arttyaaytggtaygtngayggngtngargtncayaaygcnaaracnaarccnmgngargarca
rttyaaywsnacnttymgngtngtnwsngtnmtnacngtngtncaycargaytggmtnaayggn
aargartayaartgyaargtnwsnaayaarggnmtnccngcnccnathgaraaracnathwsna
aracnaarggncarccnmgngarccncargtntayacnmtnccnccnwsnmgngargaratgac
naaraaycargtnwsnmtnacntgymtngtnaarggnttytayccnwsngayathgcngtngar
tgggarwsnaayggncarccngaraayaaytayaaracnacnccnccnatgmtngaywsngayg
gnwsnttyttymtntaywsnaarmtnacngtngayaarwsnmgntggcarcarggnaaygtntt
ywsntgywsngtnatgcaygargcnmtncayaaycaytayacncaraarwsnmtnwsnmtnwsn
ccnggnaar

FIGURE 14I

U<sub>H</sub>-19 heavy chain nucleotide sequence (SEQ ID NO:595)
gargtncarmtnmtngarwsnggnggnggnmtngtncarccnggnggnwsnmtnmgnmtnwsnt
gyacngcnwsnggnttyacnttywsnwsntaygcnatgwsntgggtnmgncargcnccnggnaa
rggnmtngartgggtnwsngcnathwsnggnwsnggnggnwsnacntaytaygcngaywsngtn
aarggnmgnttyacnathwsnmgngayaaywsnaaraayacnmtntaymtncaratgaaywsnm
tnmgngcngargayacngcngartaytaytgygcnaargarggnathgcnggnmgngaywsnta
ytaytaytayggnatggaygtntggggncarggnacnacngtnacngtnwsnwsngcnwsnacn
aarggnccnwsngtnttyccnmtngcnccntgywsnmgnwsnacnwsngarwsnacngcngcnm
tnggntgymtngtnaargaytayttyccngarccngtnacngtnwsntggaaywsnggngcnmt
nacnwsnggngtncayacnttyccngcngtnmtncarwsnwsnggnmtntaywsnmtnwsnwsn
gtngtnacngtnccnwsnwsnaayttyggnacncaracntayacntgyaaygtngaycayaarc
cnwsnaayacnaargtngayaaracngtngarmgnaartgytgygtngartgyccnccntgycc
ngcnccnccngtngcnggnccnwsngtnttymtnttyccnccnaarccnaargayacnmtnatg
athwsnmgnacnccngargtnacntgygtngtngtngaygtnwsncaygargayccngargtnc
arttyaaytggtaygtngayggngtngargtncayaaygcnaaracnaarccnmgngargarca
rttyaaywsnacnttymgngtngtnwsngtnmtnacngtngtncaycargaytggmtnaayggn
aargartayaartgyaargtnwsnaayaarggnmtccngcnccnathgaraaracnathwsna
aracnaarggncarccnmgngarccncargtntayacnmtnccnccnwsnmgngargaratgac
naaraaycargtnwsnmtnacntgymtngtnaarggnttytayccnwsngayathgcngtngar
tgggarwsnaayggncarccngaraayaaytayaaracnacnccnccnatgmtngaywsngayg
gnwsnttyttymtntaywsnaarmtnacngtngayaarwsnmgntggcarcarggnaaygtntt
ywsntgywsngtnatgcaygargcnmtncayaaycaytayacncaraarwsnmtnwsnmtnwsn
ccnggnaar U<sub>H</sub>-20 heavy chain nucleotide sequence (SEQ ID NO:595)
gargtncarmtnmtngarwsnggnggnggnmtngtncarccnggnggnwsnmtnmgnmtnwsnt
gyacngcnwsnggnttyacnttywsnwsntaygcnatgwsntgggtnmgncargcnccnggnaa
rggnmtngartgggtnwsngcnathwsnggnwsnggnggnwsnacntaytaygcngaywsngtn
aarggnmgnttyacnathwsnmgngayaaywsnaaraayacnmtntaymtncaratgaaywsnm
tnmgngcngargayacngcngartaytaytgygcnaargarggnathgcnggnmgngaywsnta
ytaytaytayggnatggaygtntggggncarggnacnacngtnacngtnwsnwsngcnwsnacn
aarggnccnwsngtnttyccnmtngcnccntgywsnmgnwsnacnwsngarwsnacngcngcnm
tnggntgymtngtnaargaytayttyccngarccngtnacngtnwsntggaaywsnggngcnmt
nacnwsnggngtncayacnttyccngcngtnmtncarwsnwsnggnmtntaywsnmtnwsnwsn
gtngtnacngtnccnwsnwsnaayttyggnacncaracntayacntgyaaygtngaycayaarc
cnwsnaayacnaargtngayaaracngtngarmgnaartgytgygtngartgyccnccntgycc
ngcnccnccngtngcnggnccnwsngtnttymtnttyccnccnaarccnaargayacnmtnatg
athwsnmgnacnccngargtnacntgygtngtngtngaygtnwsncaygargayccngargtnc
arttyaaytggtaygtngayggngtngargtncayaaygcnaaracnaarccnmgngargarca
rttyaaywsnacnttymgngtngtnwsngtnmtnacngtngtncaycargaytggmtnaayggn
aargartayaartgyaargtnwsnaayaarggnmtccngcnccnathgaraaracnathwsna
aracnaarggncarccnmgngarccncargtntayacnmtnccnccnwsnmgngargaratgac
naaraaycargtnwsnmtnacntgymtngtnaarggnttytayccnwsngayathgcngtngar
tgggarwsnaayggncarccngaraayaaytayaaracnacnccnccnatgmtngaywsngayg
gnwsnttyttymtntaywsnaarmtnacngtngayaarwsnmgntggcarcarggnaaygtntt
ywsntgywsngtnatgcaygargcnmtncayaaycaytayacncaraarwsnmtnwsnmtnwsn
ccnggnaar

FIGURE 14J

U_H-21 heavy chain nucleotide sequence (SEQ ID NO:596)
cargtncarmtngtngarwsnggnggnggngtngtncarccnggnmgnwsnmtnmgnmtnwsnt
gygcngcnwsnggnttyacnttywsnwsntayggnatgcaytgggtnmgncargcnccnggnaa
rggnmtngartgggtngcnttyathwsngaygayggnwsnacnaartaytaygcngaywsngtn
aarggnmgnttyacnathwsnmgngayaaywsnatgaayacnmtntaymtncaratgaaywsnm
tnmgngcngargayacngcngtntaytaytgygcnmgnwsntaytaygaywsnwsnggntayta
ytayggnttygaytaytggggncarggnacnmtngtnacngtnwsnwsngcnwsnacnaarggn
ccnwsngtnttyccnmtngcnccntgywsnmgnwsnacnwsngarwsnacgcngcnmtnggnt
gymtngtnaargaytayttyccngarccngtnacngtnwsntggaaywsnggngcnmtnacnws
nggngtncayacnttyccngcngtnmtncarwsnwsnggnmtntaywsnmtnwsnwsngtngtn
acngtnccnwsnwsnaayttyggnacncaracntayacntgyaaygtngaycayaarccnwsna
ayacnaargtngayaaracngtngarmgnaartgytgygtngartgyccnccntgyccngcncc
nccngtngcnggnccnwsngtnttymtnttyccnccnaarccnaargayacnmtnatgathwsn
mgnacnccngargtnacntgygtngtngtngaygtnwsncaygargayccngargtncarttya
aytggtaygtngayggngtngargtncayaaygcnaaracnaarccnmgngargarcarttyaa
ywsnacnttymgngtngtnwsngtnmtnacngtngtncaycargaytggmtnaayggnaargar
tayaartgyaargtnwsnaayaarggnmtnccngcnccnathgaraaracnathwsnaaracna
arggncarccnmgngarccncargtntayacnmtnccnccnwsnmgngargaratgacnaaraa
ycargtnwsnmtnacntgymtngtnaarggnttytayccnwsngayathgcngtngartgggar
wsnaayggncarccngaraayaaytayaaracnacnccnccnatgmtngaywsngayggnwsnt
tyttymtntaywsnaarmtnacngtngayaarwsnmgntggcarcarggnaaygtnttywsntg
ywsngtnatgcaygargcnmtncayaaycaytayacncaraarwsnmtnwsnmtnwsnccnggn
aar U_H-22 heavy chain nucleotide sequence (SEQ ID NO:596)
cargtncarmtngtngarwsnggnggnggngtngtncarccnggnmgnwsnmtnmgnmtnwsnt
gygcngcnwsnggnttyacnttywsnwsntayggnatgcaytgggtnmgncargcnccnggnaa
rggnmtngartgggtngcnttyathwsngaygayggnwsnacnaartaytaygcngaywsngtn
aarggnmgnttyacnathwsnmgngayaaywsnatgaayacnmtntaymtncaratgaaywsnm
tnmgngcngargayacngcngtntaytaytgygcnmgnwsntaytaygaywsnwsnggntayta
ytayggnttygaytaytggggncarggnacnmtngtnacngtnwsnwsngcnwsnacnaarggn
ccnwsngtnttyccnmtngcnccntgywsnmgnwsnacnwsngarwsnacgcngcnmtnggnt
gymtngtnaargaytayttyccngarccngtnacngtnwsntggaaywsnggngcnmtnacnws
nggngtncayacnttyccngcngtnmtncarwsnwsnggnmtntaywsnmtnwsnwsngtngtn
acngtnccnwsnwsnaayttyggnacncaracntayacntgyaaygtngaycayaarccnwsna
ayacnaargtngayaaracngtngarmgnaartgytgygtngartgyccnccntgyccngcncc
nccngtngcnggnccnwsngtnttymtnttyccnccnaarccnaargayacnmtnatgathwsn
mgnacnccngargtnacntgygtngtngtngaygtnwsncaygargayccngargtncarttya
aytggtaygtngayggngtngargtncayaaygcnaaracnaarccnmgngargarcarttyaa
ywsnacnttymgngtngtnwsngtnmtnacngtngtncaycargaytggmtnaayggnaargar
tayaartgyaargtnwsnaayaarggnmtnccngcnccnathgaraaracnathwsnaaracna
arggncarccnmgngarccncargtntayacnmtnccnccnwsnmgngargaratgacnaaraa
ycargtnwsnmtnacntgymtngtnaarggnttytayccnwsngayathgcngtngartgggar
wsnaayggncarccngaraayaaytayaaracnacnccnccnatgmtngaywsngayggnwsnt
tyttymtntaywsnaarmtnacngtngayaarwsnmgntggcarcarggnaaygtnttywsntg
ywsngtnatgcaygargcnmtncayaaycaytayacncaraarwsnmtnwsnmtnwsnccnggn
aar

FIGURE 14K

U$_H$-23 heavy chain nucleotide sequence (SEQ ID NO:597)
cargtncarmtngtngarwsnggnggnggngtngtncarccnggnmgnwsnmtnmgnmtnwsnt
gygcngcnwsnggnttyacnttywsnwsntayggnatgcaytgggtnmgncargcnccnggnaa
rggnmtngartgggtngcngtnathtggtaygayggnwsnaayaartaytaygcngaywsngtn
aarggnmgnttyacnathwsnmgngayaaywsnaaraayacnmtntaymtncaratgaaywsnm
tnmgngcngargayacngcngtntaytaytgygcnmgnaaygtnathgaytaytggggncargg
nacnmtngtnacngtnwsnwsngcnwsnacnaarggnccnwsngtnttyccnmtngcnccntgy
wsnmgnwsnacnwsngarwsnacngcngcnmtggntgymtngtnaargaytayttyccngarc
cngtnacngtnwsntggaaywsnggngcnmtnacnwsnggngtncayacnttyccngcngtnmt
ncarwsnwsnggnmtntaywsnmtnwsnwsngtngtnacngtnccnwsnwsnaayttyggnacn
caracntayacntgyaaygtngaycayaarccnwsnaayacnaargtngayaaracngtngarm
gnaartgytgygtngartgyccnccntgyccngcnccnccgtngcnggnccnwsngtnttymt
nttyccnccnaarccnaargayacnmtnatgathwsnmgnacnccngargtnacntgygtngtn
gtngaygtnwsncaygargayccngargtncarttyaaytggtaygtngayggngtngargtnc
ayaaygcnaaracnaarccnmgngargarcarttyaaywsnacnttymgngtngtnwsngtnmt
nacngtngtncaycargaytggmtnaayggnaargartayaartgyaargtnwsnaayaarggn
mtnccngcnccnathgaraaracnathwsnaaracnaarggncarccnmgngarccncargtnt
ayacnmtnccnccnwsnmgngargaratgacnaaraaycargtnwsnmtnacntgymtngtnaa
rggnttytayccnwsngayathgcngtngartgggarwsnaayggncarccngaraayaaytay
aaracnacnccnccnatgmtngaywsngayggnwsnttyttymtntaywsnaarmtnacngtng
ayaarwsnmgntggcarcarggnaaygtnttywsntgywsngtnatgcaygargcnmtncayaa
ycaytayacncaraarwsnmtnwsnmtnwsnccnggnaar U$_H$-24 heavy chain nucleotide sequence (SEQ ID NO:598)
cargtncarmtngtngarwsnggnggnggngtngtncarccnggnmgnwsnmtnmgnmtnwsnt
gygcngcnwsnggnttyacnttywsnwsntaygayatgcaytgggtnmgncargcnccnggnaa
rggnmtngartgggtngcngtnathtggtaygayggnwsnathaartaytaygcngaywsngtn
aarggnmgnttyacnathwsnmgngayaaywsnaaraayacnmtntaymtncaratgaaywsnm
tnmgngcngargayacngcngtntaytaytgygcnmgnggnggngcnacnggngcngartaytt
ycarcaytggggncarggnacnmtngtnacngtnwsnwsngcnwsnacnaarggnccnwsngtn
ttyccnmtngcnccntgywsnmgnwsnacnwsngarwsnacngcngcnmtggntgymtngtna
argaytayttyccngarccngtnacngtnwsntggaaywsnggngcnmtnacnwsnggngtnca
yacnttyccngcngtnmtncarwsnwsnggnmtntaywsnmtnwsnwsngtngtnacngtnccn
wsnwsnaayttyggnacncaracntayacntgyaaygtngaycayaarccnwsnaayacnaarg
tngayaaracngtngarmgnaartgytgygtngartgyccnccntgyccngcnccnccgtngc
nggnccnwsngtnttymtnttyccnccnaarccnaargayacnmtnatgathwsnmgnacnccn
gargtnacntgygtngtngtngaygtnwsncaygargayccngargtncarttyaaytggtayg
tngayggngtngargtncayaaygcnaaracnaarccnmgngargarcarttyaaywsnacntt
ymgngtngtnwsngtnmtnacngtngtncaycargaytggmtnaayggnaargartayaartgy
aargtnwsnaayaarggnmtnccngcnccnathgaraaracnathwsnaaracnaarggncarc
cnmgngarccncargtntayacnmtnccnccnwsnmgngargaratgacnaaraaycargtnws
nmtnacntgymtngtnaarggnttytayccnwsngayathgcngtngartgggarwsnaayggn
carccngaraayaaytayaaracnacnccnccnatgmtngaywsngayggnwsnttyttymtnt
aywsnaarmtnacngtngayaarwsnmgntggcarcarggnaaygtnttywsntgywsngtnat
gcaygargcnmtncayaaycaytayacncaraarwsnmtnwsnmtnwsnccnggnaar

FIGURE 14L

U<sub>R</sub>-25 heavy chain nucleotide sequence (SEQ ID NO:598)
cargtncarmtngtngarwsnggnggnggngtngtncarccnggnmgnwsnmtnmgnmtnwsnt
gygcngcnwsnggnttyacnttywsnwsntaygayatgcaytgggtnmgncargcnccnggnaa
rggnmtngartgggtngcngtnathtggtaygayggnwsnathaartaytaygcngaywsngtn
aarggnmgnttyacnathwsnmgngayaaywsnaaraayacnmtntaymtncaratgaaywsnm
tnmgngcngargayacngcngtntaytaytgygcnmgnggnggngcnacnggngcngartaytt
ycarcaytggggncarggnacnmtngtnacngtnwsnwsngcnwsnacnaarggnccnwsngtn
ttyccnmtngcnccntgywsnmgnwsnacnwsngarwsnacngcngcnmtnggntgymtngtna
argaytayttyccngarccngtnacngtnwsntggaaywsnggngcnmtnacnwsnggngtnca
yacnttyccngcngtnmtncarwsnwsnggnmtntaywsnmtnwsnwsngtngtnacngtnccn
wsnwsnaayttyggnacncaracntayacntgyaaygtngaycayaarccnwsnaayacnaarg
tngayaaracngtngarmgnaartgytgygtngartgyccnccntgyccngcnccnccngtngc
nggnccnwsngtnttymtnttyccnccnaarccnaargayacnmtnatgathwsnmgnacnccn
gargtnacntgygtngtngtngaygtnwsncaygargayccngargtncarttyaaytggtayg
tngayggngtngargtncayaaygcnaaracnaarccnmgngargarcarttyaaywsnacntt
ymgngtngtnwsngtnmtnacngtngtncaycargaytggmtnaayggnaargartayaartgy
aargtnwsnaayaarggnmtnccngcnccnathgaraaracnathwsnaaracnaarggncarc
cnmgngarccncargtntayacnmtnccnccnwsnmgngargaratgacnaaraaycargtnws
nmtnacntgymtngtnaarggnttytayccnwsngayathgcngtngartgggarwsnaayggn
carccngaraayaaytayaaracnacnccnccnatgmtngaywsngayggnwsnttyttymtnt
aywsnaarmtnacngtngayaarwsnmgntggcarcarggnaaygtnttywsntgywsngtnat
gcaygargcnmtncayaaycaytayacncaraarwsnmtnwsnmtnwsnccnggnaar U<sub>R</sub>-26 heavy chain nucleotide sequence (SEQ ID NO:599)
cargtncarmtngtngarwsnggnggnggngtngtncarccnggnmgnwsnmtnmgnmtnwsnt
gygcngcnwsnggnttyacnttywsnwsntayggnatgcaytgggtnmgncargcnccnggnaa
rggnmtngartgggtngcngtnathtggtaygayggnwsnaayaartaytaygcngaywsngtn
aarggnmgnttyacnathwsnmgngayaaywsnaaraayacnmtntaymtncaratgaaywsnm
tnmgngcngargayacngcngtntaytaytgygtnmtnmtntggttyggngaracnttygayta
ytggggncarggnwsnmtngtnacngtnwsnccngcnwsnacnaarggnccnwsngtnttyccn
mtngcnccntgywsnmgnwsnacnwsngarwsnacngcngcnmtnggntgymtngtnaargayt
ayttyccngarccngtnacngtnwsntggaaywsnggngcnmtnacnwsnggngtncayacntt
yccngcngtnmtncarwsnwsnggnmtntaywsnmtnwsnwsngtngtnacngtnccnwsnwsn
aayttyggnacncaracntayacntgyaaygtngaycayaarccnwsnaayacnaargtngaya
aracngtngarmgnaartgytgygtngartgyccnccntgyccngcnccnccngtngcnggncc
nwsngtnttymtnttyccnccnaarccnaargayacnmtnatgathwsnmgnacnccngargtn
acntgygtngtngtngaygtnwsncaygargayccngargtncarttyaaytggtaygtngayg
gngtngargtncayaaygcnaaracnaarccnmgngargarcarttyaaywsnacnttymgngt
ngtnwsngtnmtnacngtngtncaycargaytggmtnaayggnaargartayaartgyaargtn
wsnaayaarggnmtnccngcnccnathgaraaracnathwsnaaracnaarggncarccnmgng
arccncargtntayacnmtnccnccnwsnmgngargaratgacnaaraaycargtnwsnmtnac
ntgymtngtnaarggnttytayccnwsngayathgcngtngartgggarwsnaayggncarccn
garaayaaytayaaracnacnccnccnatgmtngaywsngayggnwsnttyttymtntaywsna
armtnacngtngayaarwsnmgntggcarcarggnaaygtnttywsntgywsngtnatgcayga
rgcnmtncayaaycaytayacncaraarwsnmtnwsnmtnwsnccnggnaar

FIGURE 14M

U$_H$-27 heavy chain nucleotide sequence (SEQ ID NO:600)

cargtncarmtngtngarwsnggnggnggngtngtncarccnggnmgnwsnmtnmgnmtnwsnt
gygcngcnwsnggnttyacnttywsnwsntayggnatgcaytgggtnmgncargcnccnggnaa
rggnmtngartgggtngcngtnathtggwsngayggnwsnaayaartaytaygcngaywsngtn
aarggnmgnttyacnathwsnmgngayaaywsnaaraayacnmtntaymtncaratgaaywsnm
tnmgngcngargayacngcngtntaytaytgygcnmgnaaymtnccnttygaytaytggggnca
rggnacnmtngtnacngtnwsnwsngcnwsnacnaarggnccnwsngtnttyccnmtngcccn
tgywsnmgnwsnacnwsngarwsnacngcngcnmtnggntgymtngtnaargaytayttyccng
arccngtnacngtnwsntggaaywsnggngcnmtnacnwsnggngtncayacnttyccngcngt
nmtncarwsnwsnggnmtntaywsnmtnwsnwsngtngtnacngtnccnwsnwsnaayttyggn
acncaracntayacntgyaaygtngaycayaarccnwsnaayacnaargtngayaaracngtng
armgnaartgytgygtngartgyccnccntgyccngcnccnccgtngcnggnccnwsngtntt
ymtnttyccnccnaarccnaargayacnmtnatgathwsnmgnacnccngargtnacntgygtn
gtngtngaygtnwsncaygargayccngargtncarttyaaytggtaygtngayggngtngarg
tncayaaygcnaaracnaarccnmgngargarcarttyaaywsnacnttymgngtngtnwsngt
nmtnacngtngtncaycargaytggmtnaayggnaargartayaartgyaargtnwsnaayaar
ggnmtnccngcnccnathgaraaracnathwsnaaracnaarggncarccnmgngarccncarg
tntayacnmtnccnccnwsnmgngargaratgacnaaraaycargtnwsnmtnacntgymtngt
naarggnttytayccnwsngayathgcngtngartgggarwsnaayggncarccngaraayaay
tayaaracnacnccnccnatgmtngaywsngayggnwsnttyttymtntaywsnaarmtnacng
tngayaarwsnmgntggcarcarggnaaygtnttywsntgywsngtnatgcaygargcnmtnca
yaaycaytayacncaraarwsnmtnwsnmtnwsnccnggnaar U$_H$-28 heavy chain nucleotide sequence (SEQ ID NO:601)

cargtncarmtngtngarwsnggnggnggngtngtncarccnggnmgnwsnmtnmgnmtnwsnt
gygcngcnwsnggnttyacnttywsnwsntayggnatgcaytgggtnmgncargcnccnggnaa
rggnmtngartgggtngcngtnathtggaygayggnwsnaaycartaytacngaywsngtn
aarggnmgnttyacngtnwsnmgngayaaywsnaaraayacnmtnttymtncaratgaaywsnm
tnmgngcngargayacngcngtntaytaytgygcnmgnwsncaytayggnggngaytaygayta
ytayggnatggaygtntggggncarggnacnacngtnacngtnwsnwsngcnwsnacnaarggn
ccnwsngtnttyccnmtngcncctgywsnmgnwsnacnwsngarwsnacngcgcnmtnggnt
gymtngtnaargaytayttyccngarccngtnacngtnwsntggaaywsnggngcnmtnacnws
nggngtncayacnttyccngcngtnmtncarwsnwsnggnmtntaywsnmtnwsnwsngtngtn
acngtnccnwsnwsnaayttyggnacncaracntayacntgyaaygtngaycayaarccnwsna
ayacnaargtngayaaracngtngarmgnaartgytgygtngartgyccnccntgyccngcncc
nccgtngcnggnccnwsngtnttymtnttyccnccnaarccnaargayacnmtnatgathwsn
mgnacnccngargtnacntgygtngtngtngaygtnwsncaygargayccngargtncarttya
aytggtaygtngayggngtngargtncayaaygcnaaracnaarccnmgngargarcarttyaa
ywsnacnttymgngtngtnwsngtnmtnacngtngtncaycargaytggmtnaayggnaargar
tayaartgyaargtnwsnaayaarggnmtnccngcnccnathgaraaracnathwsnaaracna
arggncarccnmgngarccncargtntayacnmtnccnccnwsnmgngargaratgacnaaraa
ycargtnwsnmtnacntgymtngtnaarggnttytayccnwsngayathgcngtngartgggar
wsnaayggncarccngaraayaaytayaaracnacnccnccnatgmtngaywsngayggnwsnt
tyttymtntaywsnaarmtnacngtngayaarwsnmgntggcarcarggnaaygtnttywsntg
ywsngtnatgcaygargcnmtncayaaycaytayacncaraarwsnmtnwsnmtnwsnccnggn
aar

FIGURE 14N

U$_H$-29 heavy chain nucleotide sequence (SEQ ID NO:602)
cargtncarmtngtngarwsnggnggnggngtngtncarccnggnmgnwsnmtnmgnmtnwsnt
gygcngcnwsnggnttyacnttywsnwsntayggnatgcaytgggtnmgncargcnccnggnaa
rggnmtngartgggtngcngtnathtggtaygayggnwsnaayaarmgntaygtngaywsngtn
aarggnmgnttyacnathwsnmgngayaaywsnaaraayacnmtntaymtncaratgaaywsnm
tnmgngcngargayacngcngtntaytaytgygcnmgngayggntggcarcarcargcnccntt
ygaytaytggggncarggnacnmtngtnacngtnwsnwsngcnwsnacnaarggnccnwsngtn
ttyccnmtngcnccntgywsnmgnwsnacnwsngarwsnacngcngcnmtnggntgymtngtna
argaytayttyccngarccngtnacngtnwsntggaaywsnggngcnmtnacnwsnggngtnca
yacnttyccngcngtnmtncarwsnwsnggnmtntaywsnmtnwsnwsngtngtnacngtnccn
wsnwsnaayttyggnacncaracntayacntgyaaygtngaycayaarccnwsnaayacnaarg
tngayaaracngtngarmgnaartgytgygtngartgyccnccntgyccngcnccnccgtngc
nggnccnwsngtnttymtnttyccnccnaarccnaargayacnmtnatgathwsnmgnacnccn
gargtnacntgygtngtngtngaygtnwsncaygargayccngargtncarttyaaytggtayg
tngayggngtngargtncayaaygcnaaracnaarccnmgngargarcarttyaaywsnacntt
ymgngtngtnwsngtnmtnacngtngtncaycargaytggmtnaayggnaargartayaartgy
aargtnwsnaayaarggnmtnccngcnccnathgaraaracnathwsnaaracnaarggncarc
cnmgngarccncargtntayacnmtnccnccnwsnmgngargaratgacnaaraaycargtnws
nmtnacntgymtngtnaarggnttytayccnwsngayathgcngtngartgggarwsnaayggn
carccngaraayaaytayaaracnacnccnccnatgmtngaywsngayggnwsnttyttymtnt
aywsnaarmtnacngtngayaarwsnmgntggcarcarggnaaygtnttywsntgywsngtnat
gcaygargcnmtncayaaycaytayacncaraarwsnmtnwsnmtnwsnccnggnaar U$_H$-30 heavy chain nucleotide sequence (SEQ ID NO:603)
cargtncarmtngtngarwsnggnggnggngtngtncarccnggnmgnwsnmtnmgnmtnwsnt
gygcngcnwsnggnttyacnttymgnwsncayggnatgcaytgggtnmgncargcnccnggnaa
rggnmtngartgggtngcngtnathtggtaygayggnwsnaayaaraaytaygcngaywsngtn
mgnggnmgnttyacnathwsnmgngayaaywsnaaraayacnmtngaymtncaratgaaywsnm
tnmgngcngargayacngcngtntaytaytgygcnmgntggggnathwsngcnccnttygaytg
ytggggncarggnacnmtngtnacngtnwsnwsngcnwsnacnaarggnccnwsngtnttyccn
mtngcnccntgywsnmgnwsnacnwsngarwsnacngcngcnmtnggntgymtngtnaargayt
ayttyccngarccngtnacngtnwsntggaaywsnggngcnmtnacnwsnggngtncayacntt
yccgcngtnmtncarwsnwsnggnmtntaywsnmtnwsnwsngtngtnacngtnccnwsnwsn
aayttyggnacncaracntayacntgyaaygtngaycayaarccnwsnaayacnaargtngaya
aracngtngarmgnaartgytgygtngartgyccnccntgyccngcnccnccgtngcnggncc
nwsngtnttymtnttyccnccnaarccnaargayacnmtnatgathwsnmgnacnccngargtn
acntgygtngtngtngaygtnwsncaygargayccngargtncarttyaaytggtaygtngayg
gngtngargtncayaaygcnaaracnaarccnmgngargarcarttyaaywsnacnttymgngt
ngtnwsngtnmtnacngtngtncaycargaytggmtnaayggnaargartayaartgyaargtn
wsnaayaarggnmtnccngcnccnathgaraaracnathwsnaaracnaarggncarccnmgng
arccncargtntayacnmtnccnccnwsnmgngargaratgacnaaraaycargtnwsnmtnac
ntgymtngtnaarggnttytayccnwsngayathgcngtngartgggarwsnaayggncarccn
garaayaaytayaaracnacnccnccnatgmtngaywsngayggnwsnttyttymtntaywsna
armtnacngtngayaarwsnmgntggcarcarggnaaygtnttywsntgywsngtnatgcayga
rgcnmtncayaaycaytayacncaraarwsnmtnwsnmtnwsnccnggnaar

FIGURE 140

U<sub>B</sub>-31 heavy chain nucleotide sequence (SEQ ID NO:604)
gargtncarmtngtngarwsnggnggnggnmtngtncarccnggnggnwsnmtnmgnmtnwsnt
gygcngcnwsnggnttyacnttywsngcntaywsnatgaaytgggtnmgncargcnccnggnaa
rggnmtngartgggtnwsntayathwsnwsnwsnggnmgnacnathtaytaygcngaywsngtn
aarggnmgnttyacnathwsnmgngayaaygcnaaraaywsnmtnttymtncaratgaaywsnm
tnmgngaygargayacngcngtntaytaytgygcnmtntgggcnccnttygaytaytggggnca
rggnacnmtngtnacngtnwsnwsngcnwsnacnaarggnccnwsngtnttyccnmtngcnccn
tgywsnmgnwsnacnwsngarwsnacngcngcnmtnggntgymtngtnaargaytayttyccng
arccngtnacngtnwsntggaaywsnggngcnmtnacnwsnggngtncayacnttyccngcgt
nmtncarwsnwsnggnmtntaywsnmtnwsnwsngtngtnacngtnccnwsnwsnaayttyggn
acncaracntayacntgyaaygtngaycayaarccnwsnaayacnaargtngayaaracngtng
armgnaartgytgygtngartgyccnccntgyccngcnccnccngtngcnggccnwsngtntt
ymtnttyccnccnaarccnaargayacnmtnatgathwsnmgnacnccngargtnacntgygtn
gtngtngaygtnwsncaygargayccngargtncarttyaaytggtaygtngayggngtngarg
tncayaaygcnaaracnaarccnmgngargarcarttyaaywsnacnttymgngtngtnwsngt
nmtnacngtngtncaycargaytggmtnaayggnaargartayaartgyaargtnwsnaayaar
ggnmtnccngcnccnathgaraaracnathwsnaaracnaarggncarccnmgngarccncarg
tntayacnmtnccnccnwsnmgngargaratgacnaaraaycargtnwsnmtnacntgymtngt
naarggnttytayccnwsngayathgcngtngartgggarwsnaayggncarccngaraayaay
tayaaracnacnccnccnatgmtngaywsngayggnwsnttyttymtntaywsnaarmtnacng
tngayaarwsnmgntggcarcarggnaaygtnttywsntgywsngtnatgcaygargcnmtnca
yaaycaytayacncaraarwsnmtnwsnmtnwsnccnggnaar U<sub>B</sub>-32 heavy chain nucleotide sequence (SEQ ID NO:605)
gargtncarmtngtngarwsnggnggnggnmtngtncarccnggnggnwsnmtnmgnmtnwsnt
gygcngcnwsnggnttyacnttywsnwsntaywsnatgaaytgggtnmgncargcnccnggnaa
rggnmtngartgggtnwsncayathwsnwsnwsnwsnmgnacnathtaytaygcngaywsngtn
aarggnmgnttyacnathwsnmgngayaaygcnaaraaywsngtntaymtncaratgaaywsnm
tnmgngaygargayacngcngtntaytaytgygcnmgngayggntayaaytggaayggnggngg
naaytaytayggnatggaygtntgggncarggnacnacngtnacngtnwsnwsngcnwsnacn
aarggnccnwsngtnttyccnmtngcnccntgywsnmgnwsnacnwsngarwsnacngcngcnm
tnggntgymtngtnaargaytayttyccngarccngtnacngtnwsntggaaywsnggngcnmt
nacnwsnggngtncayacnttyccngcngtnmtncarwsnwsnggnmtntaywsnmtnwsnwsn
gtngtnacngtnccnwsnwsnaayttyggnacncaracntayacntgyaaygtngaycayaarc
cnwsnaayacnaargtngayaaracngtngarmgnaartgytgygtngartgyccnccntgyc
ngcnccnccngtngcnggccnwsngtnttymtnttyccnccnaarccnaargayacnmtnatg
athwsnmgnacnccngargtnacntgygtngtngtngaygtnwsncaygargayccngargtnc
arttyaaytggtaygtngayggngtngargtncayaaygcnaaracnaarccnmgngargarca
rttyaaywsnacnttymgngtngtnwsngtnmtnacngtngtncaycargaytggmtnaayggn
aargartayaartgyaargtnwsnaayaarggnmtnccngcnccnathgaraaracnathwsna
aracnaarggncarccnmgngarccncargtntayacnmtnccnccnwsnmgngargaratgac
naaraaycargtnwsnmtnacntgymtngtnaarggnttytayccnwsngayathgcngtngar
tgggarwsnaayggncarccngaraayaaytayaaracnacnccnccnatgmtngaywsngayg
gnwsnttyttymtntaywsnaarmtnacngtngayaarwsnmgntggcarcarggnaaygtntt
ywsntgywsngtnatgcaygargcnmtncayaaycaytayacncaraarwsnmtnwsnmtnwsn
ccnggnaar

FIGURE 14P

U<sub>H</sub>-33 heavy chain nucleotide sequence (SEQ ID NO:606)
gargtncarmtngtngarwsnggnggnggnmtngtncarccnggnggnwsnmtnmgnmtnwsnt
gygcngcnwsnggnttyacnttywsnwsntaywsnatgaaytgggtnmgncargcnccnggnaa
rggnmtngartgggtnwsncayathwsnmgnwsnwsnmgnacnathtaytaygcngayswsngtn
aarggnmgnttyacnathwsnmgngayaaygcnaaraaywsnmtntaymtncaratgaaywsnm
tnmgngaygargayacngcngtntaytaytgygcnmgngayggntayaaytggaayaayggngg
ntaytaytaygganatggaygtntggggncarggnacnacngtnacngtnwsnwsngcnwsnacn
aarggnccnwsngtnttyccnmtngcnccntgywsnmgnwsnacnwsngarwsnacngcngcnm
tnggntgymtngtnaargaytayttyccngarccngtnacngtnwsntggaaywsnggngcnmt
nacnwsnggngtncayacnttyccngcngtnmtncarwsnwsnggnmtntaywsnmtnwsnwsn
gtngtnacngtnccnwsnwsnaayttyggnacncaracntayacntgyaaygtngaycayaarc
cnwsnaayacnaargtngayaaracngtngarmgnaartgytgygtngartgyccnccntgycc
ngcnccnccngtngcnggnccnwsngtnttymtnttyccnccnaarccnaargayacnmtnatg
athwsnmgnacnccngargtnacntgygtngtngtngaygtnwsncaygargayccngargtnc
arttyaaytggtaygtngayggngtngargtncayaaygcnaaracnaarccnmgngargarca
rttyaaywsnacnttymgngtngtnwsngtnmtnacngtngtncaycargaytggmtnaayggn
aargartayaartgyaargtnwsnaayaarggnmtnccngcnccnathgaaracnathwsna
aracnaarggncarccnmgngarccncargtntayacnmtnccnccnwsnmgngargaratgac
naaraaycargtnwsnmtnacntgymtngtnaarggnttytayccnwsngayathgcngtngar
tgggarwsnaayggncarccngaraayaaytayaaracnacnccnccnatgmtngaywsngayg
gnwsnttyttymtntaywsnaarmtnacngtngayaarwsnmgntggcarcarggnaaygtntt
ywsntgywsngtnatgcaygargcnmtncayaaycaytayacncaraarwsnmtnwsnmtnwsn
ccnggnaar U<sub>H</sub>-34 heavy chain nucleotide sequence (SEQ ID NO:606)
gargtncarmtngtngarwsnggnggnggnmtngtncarccnggnggnwsnmtnmgnmtnwsnt
gygcngcnwsnggnttyacnttywsnwsntaywsnatgaaytgggtnmgncargcnccnggnaa
rggnmtngartgggtnwsncayathwsnmgnwsnwsnmgnacnathtaytaygcngayswsngtn
aarggnmgnttyacnathwsnmgngayaaygcnaaraaywsnmtntaymtncaratgaaywsnm
tnmgngaygargayacngcngtntaytaytgygcnmgngayggntayaaytggaayaayggngg
ntaytaytaygganatggaygtntggggncarggnacnacngtnacngtnwsnwsngcnwsnacn
aarggnccnwsngtnttyccnmtngcnccntgywsnmgnwsnacnwsngarwsnacngcngcnm
tnggntgymtngtnaargaytayttyccngarccngtnacngtnwsntggaaywsnggngcnmt
nacnwsnggngtncayacnttyccngcngtnmtncarwsnwsnggnmtntaywsnmtnwsnwsn
gtngtnacngtnccnwsnwsnaayttyggnacncaracntayacntgyaaygtngaycayaarc
cnwsnaayacnaargtngayaaracngtngarmgnaartgytgygtngartgyccnccntgycc
ngcnccnccngtngcnggnccnwsngtnttymtnttyccnccnaarccnaargayacnmtnatg
athwsnmgnacnccngargtnacntgygtngtngtngaygtnwsncaygargayccngargtnc
arttyaaytggtaygtngayggngtngargtncayaaygcnaaracnaarccnmgngargarca
rttyaaywsnacnttymgngtngtnwsngtnmtnacngtngtncaycargaytggmtnaayggn
aargartayaartgyaargtnwsnaayaarggnmtnccngcnccnathgaaracnathwsna
aracnaarggncarccnmgngarccncargtntayacnmtnccnccnwsnmgngargaratgac
naaraaycargtnwsnmtnacntgymtngtnaarggnttytayccnwsngayathgcngtngar
tgggarwsnaayggncarccngaraayaaytayaaracnacnccnccnatgmtngaywsngayg
gnwsnttyttymtntaywsnaarmtnacngtngayaarwsnmgntggcarcarggnaaygtntt
ywsntgywsngtnatgcaygargcnmtncayaaycaytayacncaraarwsnmtnwsnmtnwsn
ccnggnaar

FIGURE 14Q

U<sub>H</sub>-35 heavy chain nucleotide sequence (SEQ ID NO:607)
cargtncarmtncargarwsnggnccnggnmtngtnaarccnwsncaracnmtnwsnmtnacnt
gyacngtnwsnggnggnwsngtnwsnwsnggnggntaytaytggwsntggathmgncarcaycc
nggnaarggnmtngartggathggntayathcaywsnwsnggnwsnacntaytayaayccnwsn
mtnaarwsnmgngtnacnathwsngtngayacnwsnaaraaycarttywsnmtnaaymtnwsnw
sngtnacngcngcngayacngcngtntaytaytgygcnmgnggnccntaytayggnatggaygt
ntggggncarggnacnacngtnacngtnwsnwsngcnwsnacnaarggnccnwsngtnttyccn
mtngcnccntgywsnmgnwsnacnwsngarwsnacngcngcnmtggntgymtngtnaargayt
ayttyccngarccngtnacngtnwsntggaaywsnggngcnmtnacnwsnggngtncayacntt
yccgcngtnmtncarwsnwsnggnmtntaywsnmtnwsnwsngtngtnacngtnccnwsnwsn
aayttyggnacncaracntayacntgyaaygtngaycayaarccnwsnaayacnaargtngaya
aracngtngarmgnaartgytgygtngartgyccnccntgyccngcnccncgntgcnggncc
nwsngtnttymtnttyccnccnaarccnaargayacnmtnatgathwsnmgnacnccngargtn
acntgygtngtngtngaygtnwsncaygargayccngargtncarttyaaytggtaygtngayg
gngtngargtncayaaygcnaaracnaarccnmgngargarcarttyaaywsnacnttymgngt
ngtnwsngtnmtnacngtngtncaycargaytggmtnaayggnaargartayaartgyaargtn
wsnaayaarggnmtnccngcnccnathgaraaracnathwsnaaracnaarggncarccnmgng
arccncargtntayacnmtnccnccnwsnmgngargaratgacnaaraaycargtnwsnmtnac
ntgymtngtnaarggnttytayccnwsngayathgcngtngartgggarwsnaayggncarccn
garaayaaytayaaracnacnccnccnatgmtngaywsngayggnwsnttyttymtntaywsna
armtnacngtngayaarwsnmgntggcarcarggnaaygtnttywsntgywsngtnatgcayga
rgcnmtncayaaycaytayacncaraarwsnmtnwsnmtnwsnccnggnaar U<sub>H</sub>-36 heavy chain nucleotide sequence (SEQ ID NO:608)
cargtncarmtncargarwsnggnccnggnmtngtnaarccnwsncaracnmtnwsnmtnacnt
gyacngtnwsnggnggnwsnathwsnmgnggnggntaytaytggwsntggathmgncarcaycc
nggnaarggnmtngartggathggntayathtaycaywsnggnwsnacntaytayaayccnwsn
mtnaarwsnmgngtnaayatgwsngtngayacnwsnaaraaycarttywsnmtnaarmtnwsnw
sngtnacngcngcngayacngcngtntaytaytgygcnmgngcnmtnmgnggnathgtnmtnat
ggtntaygtnmtggngcnmtngayathtggggncarggnacnaargtnacngtnwsnwsngcn
wsnacnaarggnccnwsngtnttyccnmtngcnccntgywsnmgnwsnacnwsngarwsnacng
cngcnmtggntgymtngtnaargaytayttyccngarccngtnacngtnwsntggaaywsngg
ngcnmtnacnwsnggngtncayacnttyccgcngtnmtncarwsnwsnggnmtntaywsnmtn
wsnwsngtngtnacngtnccnwsnwsnaayttyggnacncaracntayacntgyaaygtngayc
ayaarccnwsnaayacnaargtngayaaracngtngarmgnaartgytgygtngartgyccncc
ntgyccngcnccncgntgcnggnccnwsngtnttymtnttyccnccnaarccnaargayacn
mtnatgathwsnmgnacnccngargtnacntgygtngtngtngaygtnwsncaygargayccng
argtncarttyaaytggtaygtngayggngtngargtncayaaygcnaaracnaarccnmgnga
rgarcarttyaaywsnacnttymgngtngtnwsngtnmtnacngtngtncaycargaytggmtn
aayggnaargartayaartgyaargtnwsnaayaarggnmtnccngcnccnathgaraaracna
thwsnaaracnaarggncarccnmgnarccncargtntayacnmtnccnccnwsnmgngarga
ratgacnaaraaycargtnwsnmtnacntgymtngtnaarggnttytayccnwsngayathgcn
gtngartgggarwsnaayggncarccngaraayaaytayaaracnacnccnccnatgmtngayw
sngayggnwsnttyttymtntaywsnaarmtnacngtngayaarwsnmgntggcarcarggnaa
ygtnttywsntgywsngtnatgcaygargcnmtncayaaycaytayacncaraarwsnmtnwsn
mtnwsnccnggnaar

FIGURE 14R

U$_H$-37 heavy chain nucleotide sequence (SEQ ID NO:608)
cargtncarmtncargarwsnggnccnggnmtngtnaarccnwsncaracnmtnwsnmtnacnt
gyacngtnwsnggnggnwsnathwsnmgnggnggntaytaytggwsntggathmgncarcaycc
nggnaarggnmtngartggathggntayathtaycaywsnggnwsnacntaytayaayccnwsn
mtnaarwsnmgngtnaayatgwsngtngayacnwsnaaraaycarttywsnmtnaarmtnwsnw
sngtnacngcngcngayacngcngtntaytaytgygcnmgngcnmtnmgnggnathgtnmtnat
ggtntaytgtnmtnggngcnmtngayathtggggncarggnacnaargtnacngtnwsnwsngcn
wsnacnaarggnccnwsngtnttyccnmtngcnccntgywsnmgnwsnacnwsngarwsnacng
cngcnmtnggntgymtngtnaargaytayttyccngarccngtnacngtnwsntggaaywsngg
ngcnmtnacnwsnggngtncayacnttyccngcngtnmtncarwsnwsnggnmtntaywsnmtn
wsnwsngtngtnacngtnccnwsnwsnaayttyggnacncaracntayacntgyaaygtngayc
ayaarccnwsnaayacnaargtngayaaracngtngarmgnaartgytgygtngartgyccncc
ntgyccngcnccnccngtngcnggnccnwsngtnttymtnttyccnccnaarccnaargayacn
mtnatgathwsnmgnacnccngargtnacntgygtngtngtngaygtnwsncaygargayccng
argtncarttyaaytggtaygtngayggngtngargtncayaaygcnaaracnaarccnmgnga
rgarcarttyaaywsnacnttymgngtngtnwsngtnmtnacngtngtncaycargaytggmtn
aayggnaargartayaartgyaargtnwsnaayaarggnmtnccngcnccnathgaraaracna
thwsnaaracnaarggncarccnmgngarccncargtntayacnmtnccnccnwsnmgngarga
ratgacnaaraaycargtnwsnmtnacntgymtngtnaarggnttytayccnwsngayathgcn
gtngartgggarwsnaayggncarccngaraayaaytayaaracnacnccnccnatgmtngayw
sngayggnwsnttyttymtntaywsnaarmtnacngtngayaarwsnmgntggcarcarggnaa
ygtnttywsntgywsngtnatgcaygargcnmtncayaaycaytayacncaraarwsnmtnwsn
mtnwsnccnggnaar U$_H$-38 heavy chain nucleotide sequence (SEQ ID NO:609)
cargtncarmtncargarwsnggnccnggnmtngtnaarccnwsncaracnmtnwsnmtnacnt
gyacngtnwsnggnggnwsnathwsnwsnggnggntaytaytggwsntggathmgncarcaycc
nggnaarggnmtngartggathggntayathtaytwsnggnwsnacntaytayaayccnwsn
mtnaarwsnmgngtnacnathwsngtngayacnwsnaaraaycarttywsnmtnaarmtnwsnw
sngtnacngcngcngayacngcngtntaytaytgygcnmgngaygaracngtngtnmgnggnmt
nathmgntaytgytayggnatggaygtntggggncarggnacnacngtnacngtnwsnwsngcn
wsnacnaarggnccnwsngtnttyccnmtngcnccntgywsnmgnwsnacnwsngarwsnacng
cngcnmtnggntgymtngtnaargaytayttyccngarccngtnacngtnwsntggaaywsngg
ngcnmtnacnwsnggngtncayacnttyccngcngtnmtncarwsnwsnggnmtntaywsnmtn
wsnwsngtngtnacngtnccnwsnwsnaayttyggnacncaracntayacntgyaaygtngayc
ayaarccnwsnaayacnaargtngayaaracngtngarmgnaartgytgygtngartgyccncc
ntgyccngcnccnccngtngcnggnccnwsngtnttymtnttyccnccnaarccnaargayacn
mtnatgathwsnmgnacnccngargtnacntgygtngtngtngaygtnwsncaygargayccng
argtncarttyaaytggtaygtngayggngtngargtncayaaygcnaaracnaarccnmgnga
rgarcarttyaaywsnacnttymgngtngtnwsngtnmtnacngtngtncaycargaytggmtn
aayggnaargartayaartgyaargtnwsnaayaarggnmtnccngcnccnathgaraaracna
thwsnaaracnaarggncarccnmgngarccncargtntayacnmtnccnccnwsnmgngarga
ratgacnaaraaycargtnwsnmtnacntgymtngtnaarggnttytayccnwsngayathgcn
gtngartgggarwsnaayggncarccngaraayaaytayaaracnacnccnccnatgmtngayw
sngayggnwsnttyttymtntaywsnaarmtnacngtngayaarwsnmgntggcarcarggnaa
ygtnttywsntgywsngtnatgcaygargcnmtncayaaycaytayacncaraarwsnmtnwsn
mtnwsnccnggnaar

FIGURE 14S

U<sub>B</sub>-39 heavy chain nucleotide sequence (SEQ ID NO:610)
cargtncarmtncargarwsnggnccnggnmtngtnaarccnwsncaracnmtnwsnmtnaayt
gyacngtnwsnggnggnwsnathwsnwsnggnggntaytaytggwsntggathmgncarcayc
nggnaarggnmtngartggathggntayathcaytaywsnggnwsnacntaytayaayccnwsn
mtnaarwsnmgnathacnathwsngcngayacnwsnaaraaycarttywsnmtnaarmtnaayw
sngtnacngcngcngayacngcngtntaytaytgygcnmgngaymgnggnggnggngaytaygg
nmgnatggaygtntggggncarggnacnacngtnacngtnwsnwsngcnwsnacnaarggnccn
wsngtnttyccnmtngcnccntgywsnmgnwsnacnwsngarwsnacngcngcnmtnggntgym
tngtnaargaytayttyccngarccngtnacngtnwsntggaaywsnggngcnmtnacnwsngg
ngtncayacnttyccngcngtnmtncarwsnwsnggnmtntaywsnmtnwsnwsngtngtnacn
gtnccnwsnwsnaayttyggnacncaracntayacntgyaaygtngaycayaarccnwsnaaya
cnaargtngayaaracngtngarmgnaartgytgygtngartgyccnccntgyccngcnccnc
ngtngcnggnccnwsngtnttymtnttyccnccnaarccnaargayacnmtnatgathwsnmgn
acnccngargtnacntgygtngtngtngaygtnwsncaygargayccngargtncarttyaayt
ggtaygtngayggngtngargtncayaaygcnaaracnaarccnmgngargarcarttyaayws
nacnttymgngtngtnwsngtnmtnacngtngtncaycargaytggmtnaayggnaargartay
aartgyaargtnwsnaayaarggnmtnccngcnccnathgaraaracnathwsnaaracnaarg
gncarccnmgngarccncargtntayacnmtnccnccnwsnmgngargaratgacnaaraayca
rgtnwsnmtnacntgymtngtnaarggnttytayccnwsngayathgcngtngartgggarwsn
aayggncarccngaraayaaytayaaracnacnccnccnatgmtngaywsngayggnwsnttyt
tymtntaywsnaarmtnacngtngayaarwsnmgntggcarcarggnaaygtnttywsntgyws
ngtnatgcaygargcnmtncayaaycaytayacncaraarwsnmtnwsnmtnwsnccnggnaar U<sub>B</sub>-40 heavy chain nucleotide sequence (SEQ ID NO:611)
cargtncarmtncargarwsnggnccnggnmtngtnaarccnwsncaracnmtnwsnmtnaayt
gyacngtnwsnggnggnwsnathwsnwsnggnggntaytaytggwsntggathmgncarcayc
nggnaarggnmtngartggathggntayathcaytaywsnggnwsnacntaytayaayccnwsn
mtnaarwsnmgnathacnathwsngcngayacnwsnaaraaycarttywsnmtnaarmtnaayw
sngtnacngcngcngayacngcngtntaytaytgygcnmgngaymgnggnggnggngaytaygg
nmgnatggaygtntggggncarggnacnacngtnacngtnwsnwsngcnwsnacnaarggnccn
wsngtnttyccnmtngcnccntgywsnmgnwsnacnwsngarwsnacngcngcnmtnggntgym
tngtnaargaytayttyccngarccngtnacngtnwsntggaaywsnggngcnmtnacnwsngg
ngtncayacnttyccngcngtnmtncarwsnwsnggnmtntaywsnmtnwsnwsngtngtnacn
gtnccnwsnwsnaayttyggnacncaracntayacntgyaaygtngaycayaarccnwsnaaya
cnaargtngayaaracngtngarmgnaartgytgygtngartgyccnccntgyccngcnccnc
ngtngcnggnccnwsngtnttymtnttyccnccnaarccnaargayacnmtnatgathwsnmgn
acnccngargtnacntgygtngtngtngaygtnwsncaygargayccngargtncarttyaayt
ggtaygtngayggngtngargtncayaaygcnaaracnaarccnmgngargarcarttyaayws
nacnttymgngtngtnwsngtnmtnacngtngtncaycargaytggmtnaayggnaargartay
aartgyaargtnwsnaayaarggnmtnccngcnccnathgaraaracnathwsnaaracnaarg
gncarccnmgngarccncargtntayacnmtnccnccnwsnmgngargaratgacnaaraayca
rgtnwsnmtnacntgymtngtnaarggnttytayccnwsngayathgcngtngartgggarwsn
aayggncarccngaraayaaytayaaracnacnccnccnatgmtngaywsngayggnwsnttyt
tymtntaywsnaarmtnacngtngayaarwsnmgntggcarcarggnaaygtnttywsntgyws
ngtnatgcaygargcnmtncayaaycaytayacncaraarwsnmtnwsnmtnwsnccnggnaar

FIGURE 14T

U<sub>B</sub>-41 heavy chain nucleotide sequence (SEQ ID NO:612)
cargtncarmtncargarwsnggnccnggnmtngtnaarccnwsncaracnmtnwsnmtnacnt
gyacngtnwsnggnggnwsnathwsnwsnggnggntaytaytggwsntggathmgncarcaycc
nggnaarggnmtngartggathggntayathcaywsnwsnggnwsnacntaytayaayccnwsn
mtnaarwsnmgnathacnaarwsngtngayacnwsnaaraaycarttywsnmtnaarmtnwsnw
sngtnacngcngcngayacngcngtntaytaytgygcnmgnwsnaayaaytayggntgyttygc
nmtntggggnmgnggnacnmtngtnacngtnwsnwsngcnwsnacnaarggnccnwsngtntty
ccnmtngcnccntgywsnmgnwsnacnwsngarwsnacngcngcnmtggntgymtngtnaarg
aytayttyccngarccngtnacngtnwsntggaaywsnggngcnmtnacnwsnggngtncayac
nttyccngcngtnmtncarwsnwsnggnmtntaywsnmtnwsnwsngtngtnacngtnccnwsn
wsnaayttyggnacncaracntayacntgyaaygtngaycayaarccnwsnaayacnaargtng
ayaaracngtngarmgnaartgytgygtngartgyccnccntgyccngcnccnccgtngcngg
nccnwsngtnttymtnttyccnccnaarccnaargayacnmtnatgathwsnmgnacnccngar
gtnacntgygtngtngtngaygtnwsncaygargayccngargtncarttyaaytggtaygtng
ayggngtngargtncayaaygcnaaracnaarccnmgngargarcarttyaaywsnacnttymg
ngtngtnwsngtnmtnacngtngtncaycargaytggmtnaayggnaargartayaartgyaar
gtnwsnaayaarggnmtnccngcnccnathgaraaracnathwsnaaracnaarggncarccnm
gngarccncargtntayacnmtnccnccnwsnmgngargaratgacnaaraaycargtnwsnmt
nacntgymtngtnaarggnttytayccnwsngayathgcngtngartgggarwsnaayggncar
ccngaraayaaytayaaracnacnccnccnatgmtngaywsngayggnwsnttyttymtntayw
snaarmtnacngtngayaarwsnmgntggcarcarggnaaygtnttywsntgywsngtnatgca
ygargcnmtncayaaycaytayacncaraarwsnmtnwsnmtnwsnccnggnaar U<sub>B</sub>-42 heavy chain nucleotide sequence (SEQ ID NO:613)
cargtncarmtncargarwsnggnccnggnmtngtnaarccnwsncaracnmtnwsnmtnacnt
gyacngtnwsnggnggnwsnathwsnwsnggnggntaytaytggwsntggathmgncarcaycc
nggnaarggnmtngartggathggntayathcaywsnwsnggnwsnacntaytayaayccnwsn
mtnaarwsnmgnathacnaarwsngtngayacnwsnaaraaycarttywsnmtnaarmtnwsnw
sngtnacngcngcngayacngcngtntaytaytgygcnmgnwsnaayaaytayggntgyttygc
nmtntggggnmgnggnacnmtngtnacngtnwsnwsngcnwsnacnaarggnccnwsngtntty
ccnmtngcnccntgywsnmgnwsnacnwsngarwsnacngcngcnmtggntgymtngtnaarg
aytayttyccngarccngtnacngtnwsntggaaywsnggngcnmtnacnwsnggngtncayac
nttyccngcngtnmtncarwsnwsnggnmtntaywsnmtnwsnwsngtngtnacngtnccnwsn
wsnaayttyggnacncaracntayacntgyaaygtngaycayaarccnwsnaayacnaargtng
ayaaracngtngarmgnaartgytgygtngartgyccnccntgyccngcnccnccgtngcngg
nccnwsngtnttymtnttyccnccnaarccnaargayacnmtnatgathwsnmgnacnccngar
gtnacntgygtngtngtngaygtnwsncaygargayccngargtncarttyaaytggtaygtng
ayggngtngargtncayaaygcnaaracnaarccnmgngargarcarttyaaywsnacnttymg
ngtngtnwsngtnmtnacngtngtncaycargaytggmtnaayggnaargartayaartgyaar
gtnwsnaayaarggnmtnccngcnccnathgaraaracnathwsnaaracnaarggncarccnm
gngarccncargtntayacnmtnccnccnwsnmgngargaratgacnaaraaycargtnwsnmt
nacntgymtngtnaarggnttytayccnwsngayathgcngtngartgggarwsnaayggncar
ccngaraayaaytayaaracnacnccnccnatgmtngaywsngayggnwsnttyttymtntayw
snaarmtnacngtngayaarwsnmgntggcarcarggnaaygtnttywsntgywsngtnatgca
ygargcnmtncayaaycaytayacncaraarwsnmtnwsnmtnwsnccnggnaar

FIGURE 14U

U<sub>B</sub>-43 heavy chain nucleotide sequence (SEQ ID NO:614)
cargtncarmtncargarwsnggnccnggnmtngtnaarccnwsncaracnmtnwsnmtnacnt
gyacngtnwsnggnggnwsnathwsnwsnggnggntaytaytggwsntggathmgncarcaycc
nggnaarggnmtngartggathggntayathcaytaywsnggnwsnacntaytayaayccnwsn
mtnaarwsnmgngtnacnathwsngtngayacnwsnaaraaycarttywsnmtnaarmtnwsnw
sngtnacngcngcngayacngcngtntaytaytgygcnwsnggntayaaytayggnmtntayta
ytaygaywsnwsnggntayccnwsntaytaytayggnatggaygtntggggncarggnacnacn
gtnacngtnwsnwsngcnwsnacnaarggnccnwsngtnttyccnmtngcnccntgywsnmgnw
snacnwsngarwsnacngcngcnmtnggntgymtngtnaargaytayttyccngarccngtnac
ngtnwsntggaaywsnggngcnmtnacnwsnggngtncayacnttyccngcngtnmtncarwsn
wsnggnmtntaywsnmtnwsnwsngtngtnacngtnccnwsnwsnaayttyggnacncaracnt
ayacntgyaaygtngaycayaarccnwsnaayacnaargtngayaaracngtngarmgnaartg
ytgygtngartgyccnccntgyccngcnccnccgtngcnggnccnwsngtnttymtnttyccn
ccnaarccnaargayacnmtnatgathwsnmgnacnccngargtnacntgygtngtngtngayg
tnwsncaygargayccngargtncarttyaaytggtaygtngayggngtngargtncayaaygc
naaracnaarccnmgngargarcarttyaaywsnacnttymgngtngtnwsngtnmtnacngtn
gtncaycargaytggmtnaayggnaargartayaartgyaargtnwsnaayaarggnmtnccng
cnccnathgaraaracnathwsnaaracnaarggncarccnmgngarccncargtntayacnmt
nccnccnwsnmgngargaratgacnaaraaycargtnwsnmtnacntgymtngtnaarggntty
tayccnwsngayathgcngtngartgggarwsnaayggncarccngaraayaaytayaaracna
cnccnccnatgmtngaywsngayggnwsnttyttymtntaywsnaarmtnacngtngayaarws
nmgntggcarcarggnaaygtnttywsntgywsngtnatgcaygargcnmtncayaaycaytay
acncaraarwsnmtnwsnmtnwsnccnggnaar U<sub>B</sub>-44 heavy chain nucleotide sequence (SEQ ID NO:615)
cargtncarmtncargarwsnggnccnggnmtngtnaarccnwsncaracnmtnwsnmtnacnt
gyacngtnwsnggnggnwsnathwsnwsnggngaytaytaytggaaytgggtnmgncarcayсс
nggnaarggnmtngartggathggntayathtaytaywsnggnggnacntaytayaayccnwsn
mtnaarwsnmgngtnacnathwsngtngayacnwsnaaraaycarttywsnmtnaarmtnttyw
sngtnacngcngcngayacngcngtntayttytgygcnmgnacntaytaygayathmtnacngg
ntayccnttytayttygaytaytggggncarggnacnmtngtnacngtnwsnwsngcnwsnacn
aarggnccnwsngtnttyccnmtngcnccntgywsnmgnwsnacnwsngarwsnacngcngcnm
tnggntgymtngtnaargaytayttyccngarccngtnacngtnwsntggaaywsnggngcnmt
nacnwsnggngtncayacnttyccngcngtnmtncarwsnwsnggnmtntaywsnmtnwsnwsn
gtngtnacngtnccnwsnwsnaayttyggnacncaracntayacntgyaaygtngaycayaarc
cnwsnaayacnaargtngayaaracngtngarmgnaartgytgygtngartgyccncсntgyсс
ngcnccnccngtngcnggnccnwsngtnttymtnttyccnccnaarccnaargayacnmtnatg
athwsnmgnacnccngargtnacntgygtngtngtngaygtnwsncaygargayccngargtnc
arttyaaytggtaygtngayggngtngargtncayaaygcnaaracnaarccnmgngargarca
rttyaaywsnacnttymgngtngtnwsngtnmtnacngtngtncaycargaytggmtnaayggn
aargartayaartgyaargtnwsnaayaarggnmtnccngcnccnathgaraaracnathwsna
aracnaarggncarccnmgngarccncargtntayacnmtnccnccnwsnmgngargaratgac
naaraaycargtnwsnmtnacntgymtngtnaarggnttytayccnwsngayathgcngtngar
tgggarwsnaayggncarccngaraayaaytayaaracnacnccnccnatgmtngaywsngayg
gnwsnttyttymtntaywsnaarmtnacngtngayaarwsnmgntggcarcarggnaaygtntt
ywsntgywsngtnatgcaygargcnmtncayaaycaytayacncaraarwsnmtnwsnmtnwsn
ccnggnaar

FIGURE 14V

U$_H$-45 heavy chain nucleotide sequence (SEQ ID NO:616)
cargtncarmtncargarwsnggnccnggnmtngtnaarccnwsncaracnmtnwsnmtnacnt
gyacngtnwsnggnggnwsnathwsnwsnggngaytaytaytggaaytgggtnmgncarcaycc
nggnaarggnmtngartggathggntayathtaytaywsnggnggnacntaytayaayccnwsn
mtnaarwsnmgngtnacnathwsngtngayacnwsnaaraaycarttywsnmtnaarmtnttyw
sngtnacngcngcngayacngcngtntayttytgygcnmgnacntaytaygayathmtnacngg
ntayccnttytayttygaytaytggggncarggnacnmtngtnacngtnwsnwsngcnwsnacn
aarggnccnwsngtnttyccnmtngcnccntgywsnmgnwsnacnwsngarwsnacngcngcnm
tnggntgymtngtnaargaytayttyccngarccngtnacngtnwsntggaaywsnggngcnmt
nacnwsnggngtncayacnttyccngcngtnmtncarwsnwsnggnmtntaywsnmtnwsnwsn
gtngtnacngtnccnwsnwsnaayttyggnacncaracntayacntgyaaygtngaycayaarc
cnwsnaayacnaargtngayaaracngtngarmgnaartgytgygtngartgyccnccntgyc
ngcnccnccngtngcnggnccnwsngtnttymtnttyccnccnaarccnaargayacnmtnatg
athwsnmgnacnccngargtnacntgygtngtngtngaygtnwsncaygargayccngargtnc
arttyaaytggtaygtngayggngtngargtncayaaygcnaaracnaarccnmgngargarca
rttyaaywsnacnttymgngtngtnwsngtnmtnacngtngtncaycargaytggmtnaayggn
aargartayaartgyaargtnwsnaayaarggnmtnccngcnccnathgaraaracnathwsna
aracnaarggncarccnmgngarccncargtntayacnmtnccnccnwsnmgngargaratgac
naaraaycargtnwsnmtnacntgymtngtnaarggnttytayccnwsngayathgcngtngar
tgggarwsnaayggncarccngaraayaaytayaaracnacnccnccnatgmtngaywsngayg
gnwsnttyttymtntaywsnaarmtnacngtngayaarwsnmgntggcarcarggnaaygtntt
ywsntgywsngtnatgcaygargcnmtncayaaycaytayacncaraarwsnmtnwsnmtnwsn
ccnggnaar U$_H$-46 heavy chain nucleotide sequence (SEQ ID NO:617)
cargtncarmtncarcartggggngcnggnmtnmtnaarccnwsngaracnmtnwsnmtnacnt
gygcngtntayggnggnwsnttywsnggntaytaytggwsntggathmgncarccnccnggnaa
rggnmtngartggathggngarathaaycaywsnggnwsnacnaaytayaayccnwsnmtnaar
wsnmgngtnacnathwsngtngayacnwsnaaraaycarttywsnmtnaarmtnwsnwsngtna
cngcngcngayacngcngtntaytaytgygcnmgnggnggntaywsnwsnwsntggtaytggtt
ygayccntggggncarggnacnmtngtnacngtnwsnwsngcnwsnacnaarggnccnwsngtn
ttyccnmtngcnccntgywsnmgnwsnacnwsngarwsnacngcngcnmtnggntgymtngtna
argaytayttyccngarccngtnacngtnwsntggaaywsnggngcnmtnacnwsnggngtnca
yacnttyccngcngtnmtncarwsnwsnggnmtntaywsnmtnwsnwsngtngtnacngtnccn
wsnwsnaayttyggnacncaracntayacntgyaaygtngaycayaarccnwsnaayacnaarg
tngayaaracngtngarmgnaartgytgygtngartgyccnccntgyccngcnccnccngtngc
nggnccnwsngtnttymtnttyccnccnaarccnaargayacnmtnatgathwsnmgnacnccn
gargtnacntgygtngtngtngaygtnwsncaygargayccngargtncarttyaaytggtayg
tngayggngtngargtncayaaygcnaaracnaarccnmgngargarcarttyaaywsnacntt
ymgngtngtnwsngtnmtnacngtngtncaycargaytggmtnaayggnaargartayaartgy
aargtnwsnaayaarggnmtnccngcnccnathgaraaracnathwsnaaracnaarggncarc
cnmgngarccncargtntayacnmtnccnccnwsnmgngargaratgacnaaraaycargtnws
nmtnacntgymtngtnaarggnttytayccnwsngayathgcngtngartgggarwsnaayggn
carccngaraayaaytayaaracnacnccnccnatgmtngaywsngayggnwsnttyttymtnt
aywsnaarmtnacngtngayaarwsnmgntggcarcarggnaaygtnttywsntgywsngtnat
gcaygargcnmtncayaaycaytayacncaraarwsnmtnwsnmtnwsnccnggnaar

FIGURE 14W

U<sub>B</sub>-47 heavy chain nucleotide sequence (SEQ ID NO:618)
cargtncarmtncarcartggggngcnggnmtnmtnaarccnwsngaracnmtnwsnmtnacnt
gygcngtntayggnggnwsnttywsnggntaytaytggwsntggathmgncarccnccnggnaa
rggnmtngartggathggngarathaaycaywsnggnwsnacnaaytayaayccnwsnmtnaar
wsnmgngtnacnathwsngtngayacnwsnaaraaycarttywsnmtnaarmtnwsnwsngtna
cngcngcngayacngcngtntaytaytgygcnmgnggnggntaywsnwsnwsntggttytggtt
ygayccntggggncarggnacnmtngtnacngtnwsnwsngcnwsnacnaarggnccnwsngtn
ttyccnmtngcnccntgywsnmgnwsnacnwsngarwsnacgcngcnmtnggntgymtngtna
argaytayttyccngarccngtnacngtnwsntggaaywsnggngcnmtnacnwsnggngtnca
yacnttyccngcngtnmtncarwsnwsnggnmtntaywsnmtnwsnwsngtngtnacngtnccn
wsnwsnaayttyggnacncaracntayacntgyaaygtngaycayaarccnwsnaayacnaarg
tngayaaracngtngarmgnaartgytgygtngartgyccnccntgyccngcnccnccngtngc
nggnccnwsngtnttymtnttyccnccnaarccnaargayacnmtnatgathwsnmgnacnccn
gargtnacntgygtngtngtngaygtnwsncaygargayccngargtncarttyaaytggtayg
tngayggngtngargtncayaaygcnaaracnaarccnmgngargarcarttyaaywsnacntt
ymgngtngtnwsngtnmtnacngtngtncaycargaytggmtnaayggnaargartayaartgy
aargtnwsnaayaarggnmtnccngcnccnathgaraaracnathwsnaaracnaarggncarc
cnmgngarccncargtntayacnmtnccnccnwsnmgngargaratgacnaaraaycargtnws
nmtnacntgymtngtnaarggnttytayccnwsngayathgcngtngartgggarwsnaayggn
carccngaraayaaytayaaracnacnccnccnatgmtngaywsngayggnwsnttyttymtnt
aywsnaarmtnacngtngayaarwsnmgntggcarcarggnaaygtnttywsntgywsngtnat
gcaygargcnmtncayaaycaytayacncaraarwsnmtnwsnmtnwsnccnggnaar U<sub>B</sub>-48 heavy chain nucleotide sequence (SEQ ID NO:618)
cargtncarmtncarcartggggngcnggnmtnmtnaarccnwsngaracnmtnwsnmtnacnt
gygcngtntayggnggnwsnttywsnggntaytaytggwsntggathmgncarccnccnggnaa
rggnmtngartggathggngarathaaycaywsnggnwsnacnaaytayaayccnwsnmtnaar
wsnmgngtnacnathwsngtngayacnwsnaaraaycarttywsnmtnaarmtnwsnwsngtna
cngcngcngayacngcngtntaytaytgygcnmgnggnggntaywsnwsnwsntggttytggtt
ygayccntggggncarggnacnmtngtnacngtnwsnwsngcnwsnacnaarggnccnwsngtn
ttyccnmtngcnccntgywsnmgnwsnacnwsngarwsnacgcngcnmtnggntgymtngtna
argaytayttyccngarccngtnacngtnwsntggaaywsnggngcnmtnacnwsnggngtnca
yacnttyccngcngtnmtncarwsnwsnggnmtntaywsnmtnwsnwsngtngtnacngtnccn
wsnwsnaayttyggnacncaracntayacntgyaaygtngaycayaarccnwsnaayacnaarg
tngayaaracngtngarmgnaartgytgygtngartgyccnccntgyccngcnccnccngtngc
nggnccnwsngtnttymtnttyccnccnaarccnaargayacnmtnatgathwsnmgnacnccn
gargtnacntgygtngtngtngaygtnwsncaygargayccngargtncarttyaaytggtayg
tngayggngtngargtncayaaygcnaaracnaarccnmgngargarcarttyaaywsnacntt
ymgngtngtnwsngtnmtnacngtngtncaycargaytggmtnaayggnaargartayaartgy
aargtnwsnaayaarggnmtnccngcnccnathgaraaracnathwsnaaracnaarggncarc
cnmgngarccncargtntayacnmtnccnccnwsnmgngargaratgacnaaraaycargtnws
nmtnacntgymtngtnaarggnttytayccnwsngayathgcngtngartgggarwsnaayggn
carccngaraayaaytayaaracnacnccnccnatgmtngaywsngayggnwsnttyttymtnt
aywsnaarmtnacngtngayaarwsnmgntggcarcarggnaaygtnttywsntgywsngtnat
gcaygargcnmtncayaaycaytayacncaraarwsnmtnwsnmtnwsnccnggnaar

FIGURE 14X

U$_H$-49 heavy chain nucleotide sequence (SEQ ID NO:618)
cargtncarmtncarcartggggngcnggnmtnmtnaarccnwsngaracnmtnwsnmtnacnt
gygcngtntayggnggnwsnttywsnggntaytaytggwsntggathmgncarccnccnggnaa
rggnmtngartggathggngarathaaycaywsnggnwsnacnaaytayaaccnwsnmtnaar
wsnmgngtnacnathwsngtngayacnwsnaaraaycarttywsnmtnaarmtnwsnwsngtna
cngcngcngayacngcngtntaytaytgygcnmgnggnggntaywsnwsnwsntggttytggtt
ygayccntggggncarggnacnmtngtnacngtnwsnwsngcnwsnacnaarggnccnwsngtn
ttyccnmtgcnccntgywsnmgnwsnacnwsngarwsnacngcngcnmtggntgymtngtna
argaytayttyccngarccngtnacngtnwsntggaaywsnggngcnmtnacnwsnggngtnca
yacnttyccngcngtnmtncarwsnwsnggnmtntaywsnmtnwsnwsngtngtnacngtnccn
wsnwsnaayttyggnacncaracntayacntgyaaygtngaycayaarccnwsnaayacnaarg
tngayaaracngtngarmgnaartgytgygtngartgyccnccntgyccngcncnccgtngc
nggnccnwsngtnttymtnttyccnccnaarccnaargayacnmtnatgathwsnmgnacnccn
gargtnacntgygtngtngtngaygtnwsncaygargayccngargtncarttyaaytggtayg
tngayggngtngargtncayaaygcnaaracnaarccnmgngargarcarttyaaywsnacntt
ymgngtngtnwsngtnmtnacngtngtncaycargaytggmtnaayggnaargartayaartgy
aargtnwsnaayaarggnmtnccngcnccnathgaraaracnathwsnaaracnaarggncarc
cnmgngarccncargtntayacnmtnccnccnwsnmgngargaratgacnaaraaycargtnws
nmtnacntgymtngtnaarggnttytayccnwsngayathgcngtngartgggarwsnaayggn
carccngaraayaaytayaaracnacnccnccnatgmtngaywsngayggnwsnttyttymtnt
aywsnaarmtnacngtngayaarwsnmgntggcarcarggnaaygtnttywsntgywsngtnat
gcaygargcnmtncayaaycaytayacncaraarwsnmtnwsnmtnwsnccnggnaar U$_H$-50 heavy chain nucleotide sequence (SEQ ID NO:618)
cargtncarmtncarcartggggngcnggnmtnmtnaarccnwsngaracnmtnwsnmtnacnt
gygcngtntayggnggnwsnttywsnggntaytaytggwsntggathmgncarccnccnggnaa
rggnmtngartggathggngarathaaycaywsnggnwsnacnaaytayaaccnwsnmtnaar
wsnmgngtnacnathwsngtngayacnwsnaaraaycarttywsnmtnaarmtnwsnwsngtna
cngcngcngayacngcngtntaytaytgygcnmgnggnggntaywsnwsnwsntggttytggtt
ygayccntggggncarggnacnmtngtnacngtnwsnwsngcnwsnacnaarggnccnwsngtn
ttyccnmtgcnccntgywsnmgnwsnacnwsngarwsnacngcngcnmtggntgymtngtna
argaytayttyccngarccngtnacngtnwsntggaaywsnggngcnmtnacnwsnggngtnca
yacnttyccngcngtnmtncarwsnwsnggnmtntaywsnmtnwsnwsngtngtnacngtnccn
wsnwsnaayttyggnacncaracntayacntgyaaygtngaycayaarccnwsnaayacnaarg
tngayaaracngtngarmgnaartgytgygtngartgyccnccntgyccngcncnccgtngc
nggnccnwsngtnttymtnttyccnccnaarccnaargayacnmtnatgathwsnmgnacnccn
gargtnacntgygtngtngtngaygtnwsncaygargayccngargtncarttyaaytggtayg
tngayggngtngargtncayaaygcnaaracnaarccnmgngargarcarttyaaywsnacntt
ymgngtngtnwsngtnmtnacngtngtncaycargaytggmtnaayggnaargartayaartgy
aargtnwsnaayaarggnmtnccngcnccnathgaraaracnathwsnaaracnaarggncarc
cnmgngarccncargtntayacnmtnccnccnwsnmgngargaratgacnaaraaycargtnws
nmtnacntgymtngtnaarggnttytayccnwsngayathgcngtngartgggarwsnaayggn
carccngaraayaaytayaaracnacnccnccnatgmtngaywsngayggnwsnttyttymtnt
aywsnaarmtnacngtngayaarwsnmgntggcarcarggnaaygtnttywsntgywsngtnat
gcaygargcnmtncayaaycaytayacncaraarwsnmtnwsnmtnwsnccnggnaar

FIGURE 14Y

U$_H$-51 heavy chain nucleotide sequence (SEQ ID NO:619)
cargtncarmtncargarwsnggnccnggnmtngtnaarccnwsngaracnmtnwsnmtnacnt
gyacngtnwsnggnggnwsnathwsnwsntaytaytggwsntggathmgncarccngcnggnaa
rggnmtngartggathggnmgnathtayacnwsnggnacnacnaaytayaayccnwsnmtnaar
wsnmgngtnacnatgwsngtngayacnwsnaaraaycarttywsnmtnaarmtnwsnwsngtna
cngcngcngayacngcngtntaytaytgygcnmgngayggntaywsntayggncaytaytayta
ytayggnatggaygtntggggncarggnacnacngtnacngtnwsnwsngcnwsnacnaarggn
ccnwsngtnttyccnmtngcnccntgywsnmgnwsnacnwsngarwsnacngcngcnmtggnt
gymtngtnaargaytayttyccngarccngtnacngtnwsntggaaywsnggngcnmtnacnws
nggngtncayacnttyccngcngtnmtncarwsnwsnggnmtntaywsnmtnwsnwsngtngtn
acngtnccnwsnwsnaayttyggnacncaracntayacntgyaaygtngaycayaarccnwsna
ayacnaargtngayaaracngtngarmgnaartgytgygtngartgyccnccntgyccngcncc
nccngtngcnggnccnwsngtnttymtnttyccnccnaarccnaargayacnmtnatgathwsn
mgnacnccngargtnacntgygtngtngtngaygtnwsncaygargayccngargtncarttya
aytggtaygtngayggngtngargtncayaaygcnaaracnaarccnmgngargarcarttyaa
ywsnacnttymgngtngtnwsngtnmtnacngtngtncaycargaytggmtnaayggnaargar
tayaartgyaargtnwsnaayaarggnmtnccngcnccnathgaraaracnathwsnaaracna
arggncarccnmgngarccncargtntayacnmtnccnccnwsnmgngargaratgacnaaraa
ycargtnwsnmtnacntgymtngtnaarggnttytayccnwsngayathgcngtngartgggar
wsnaayggncarccngaraayaaytayaaracnacnccnccnatgmtngaywsngayggnwsnt
tyttymtntaywsnaarmtnacngtngayaarwsnmgntggcarcarggnaaygtnttywsntg
ywsngtnatgcaygargcnmtncayaaycaytayacncaraarwsnmtnwsnmtnwsnccnggn
aar U$_H$-52 heavy chain nucleotide sequence (SEQ ID NO:620)
cargtncarmtncargarwsnggnccnggnmtngtnaarccnwsngaracnmtnwsnmtnacnt
gyacngtnwsnggnggnwsngtnwsnwsnggnggnwsntaytggwsntggathmgncarccncc
nggnaarggnmtngartggathggntayathtaytaywsnggnwsnacnaaytayaayccnwsn
mtnaarwsnmgngtnacnathwsnathgtnacnwsnmgnaaycarttywsnmtnaarmtnwsnw
sngtnacngcngcngayacngcngtntaytaytgygcnmgnwsngcnmtnmgntayttygaytg
gmtnttywsngaygtnwsngayathtggggncarggnacnatggtnacngtnwsnwsngcnwsn
acnaarggnccnwsngtnttyccnmtngcnccntgywsnmgnwsnacnwsngarwsnacngcng
cnmtggntgymtngtnaargaytayttyccngarccngtnacngtnwsntggaaywsnggngc
nmtnacnwsnggngtncayacnttyccngcngtnmtncarwsnwsnggnmtntaywsnmtnwsn
wsngtngtnacngtnccnwsnwsnaayttyggnacncaracntayacntgyaaygtngaycaya
arccnwsnaayacnaargtngayaaracngtngarmgnaartgytgygtngartgyccnccntg
yccngcnccnccngtngcnggnccnwsngtnttymtnttyccnccnaarccnaargayacnmtn
atgathwsnmgnacnccngargtnacntgygtngtngtngaygtnwsncaygargayccngarg
tncarttyaaytggtaygtngayggngtngargtncayaaygcnaaracnaarccnmgngarga
rcarttyaaywsnacnttymgngtngtnwsngtnmtnacngtngtncaycargaytggmtnaay
ggnaargartayaartgyaargtnwsnaayaarggnmtnccngcnccnathgaraaracnathw
snaaracnaarggncarccnmgngarccncargtntayacnmtnccnccnwsnmgngargarat
gacnaaraaycargtnwsnmtnacntgymtngtnaarggnttytayccnwsngayathgcngtn
gartgggarwsnaayggncarccngaraayaaytayaaracnacnccnccnatgmtngaywsng
ayggnwsnttyttymtntaywsnaarmtnacngtngayaarwsnmgntggcarcarggnaaygt
nttywsntgywsngtnatgcaygargcnmtncayaaycaytayacncaraarwsnmtnwsnmtn
wsnccnggnaar

FIGURE 14Z

U<sub>H</sub>-53 heavy chain nucleotide sequence (SEQ ID NO:620)
cargtncarmtncargarwsnggnccnggnmtngtnaarccnwsngaracnmtnwsnmtnacnt
gyacngtnwsnggnggnwsngtnwsnwsnggnggnwsntaytggwsntggathmgncarccncc
nggnaarggnmtngartggathggntayathtaytaywsnggnwsnacnaaytayaayccnwsn
mtnaarwsnmgngtnacnathwsnathgtnacnwsnmgnaaycarttywsnmtnaarmtnwsnw
sngtnacngcngcngayacngcngtntaytaytgygcnmgnwsngcnmtnmgntayttygaytg
gmtnttywsngaygtnwsngayathtggggncarggnacnatggtnacngtnwsnwsngcnwsn
acnaarggnccnwsngtnttyccnmtngcnccntgywsnmgnwsnacnwsngarwsnacngcng
cnmtnggntgymtngtnaargaytayttyccngarccngtnacngtnwsntggaaywsnggngc
nmtnacnwsnggngtncayacnttyccngcngtnmtncarwsnwsnggnmtntaywsnmtnwsn
wsngtngtnacngtnccnwsnwsnaayttyggnacncaracntayacntgyaaygtngaycaya
arccnwsnaayacnaargtngayaaracngtngarmgnaartgytgygtngartgyccnccntg
yccngcnccnccngtngcnggnccnwsngtnttymtnttyccnccnaarccnaargayacnmtn
atgathwsnmgnacnccngargtnacntgygtngtngtngaygtnwsncaygargayccngarg
tncarttyaaytggtaygtngayggngtngargtncayaaygcnaaracnaarccnmgngarga
rcarttyaaywsnacnttymgngtngtnwsngtnmtnacngtngtncaycargaytggmtnaay
ggnaargartayaartgyaargtnwsnaayaarggnmtnccngcnccnathgaraaracnathw
snaaracnaarggncarccnmgngarccncargtntayacnmtnccnccnwsnmgngargarat
gacnaaraaycargtnwsnmtnacntgymtngtnaarggnttytayccnwsngayathgcngtn
gartgggarwsnaayggncarccngaraayaaytayaaracnacnccnccnatgmtngaywsng
ayggnwsnttyttymtntaywsnaarmtnacngtngayaarwsnmgntggcarcarggnaaygt
nttywsntgywsngtnatgcaygargcnmtncayaaycaytayacncaraarwsnmtnwsnmtn
wsnccnggnaar U<sub>H</sub>-54 heavy chain nucleotide sequence (SEQ ID NO:621)
gargtncarmtngtncarwsnggngcngarmtnaaraarccnggngarwsnmtnaarathwsnt
gyaarggnwsnggntaymgnttyacnwsntaytggathggntgggtnmgncaratgccnggnaa
rggnmtngartggatgggnathathtayccngaygaywsngayacnmgntaywsnccnwsntty
carggncargtnacnathwsngcngayaarwsnathwsnacngcntaymtncartggwsnwsnm
tnaargcnwsngayacngcnatgtaytaytgygcnmgncaraarwsntayggntaywsntaytt
ygaytaytggggncarggnacnmtngtnacngtnwsnwsngcnwsnacnaarggnccnwsngtn
ttyccnmtngcnccntgywsnmgnwsnacnwsngarwsnacngcngcnmtnggntgymtngtna
argaytayttyccngarccngtnacngtnwsntggaaywsnggngcnmtnacnwsnggngtnca
yacnttyccngcngtnmtncarwsnwsnggnmtntaywsnmtnwsnwsngtngtnacngtnccn
wsnwsnaayttyggnacncaracntayacntgyaaygtngaycayaarccnwsnaayacnaarg
tngayaaracngtngarmgnaartgytgygtngartgyccnccntgyccngcnccnccngtngc
nggnccnwsngtnttymtnttyccnccnaarccnaargayacnmtnatgathwsnmgnacnccn
gargtnacntgygtngtngtngaygtnwsncaygargayccngargtncarttyaaytggtayg
tngayggngtngargtncayaaygcnaaracnaarccnmgngargarcarttyaaywsnacntt
ymgngtngtnwsngtnmtnacngtngtncaycargaytggmtnaayggnaargartayaartgy
aargtnwsnaayaarggnmtnccngcnccnathgaraaracnathwsnaaracnaarggncarc
cnmgngarccncargtntayacnmtnccnccnwsnmgngargaratgacnaaraaycargtnws
nmtnacntgymtngtnaarggnttytayccnwsngayathgcngtngartgggarwsnaayggn
carccngaraayaaytayaaracnacnccnccnatgmtngaywsngayggnwsnttyttymtnt
aywsnaarmtnacngtngayaarwsnmgntggcarcarggnaaygtnttywsntgywsngtnat
gcaygargcnmtncayaaycaytayacncaraarwsnmtnwsnmtnwsnccnggnaar

FIGURE 14AA

U<sub>H</sub>-55 heavy chain nucleotide sequence (SEQ ID NO:622)
gargtncarmtngtncarwsnggngcngargtnaaraarccnggngarwsnmtnaarathwsnt
gyaarggnwsnggntaywsnttyacnwsntaytggathggntgggtnmgncaratgccnggnaa
rggnmtngartggatgggnathathtayccngaygaywsngaygcnmgntaywsnccnwsntty
carggncargtnacnathwsngcngayaarwsnathaayacngcntaymtcartggwsnwsnm
tnaargcnwsngayacngcnatgtaytaytgygcnmgncarggntayggnwsnggntggggnta
yttygaytaytggggncarggnacnmtngtnacngtnwsnwsngcnwsnacnaarggnccnwsn
gtnttyccnmtngcnccntgywsnmgnwsnacnwsngarwsnacngcngcnmtnggntgymtng
tnaargaytayttyccngarccngtnacngtnwsntggaaywsnggngcnmtnacnwsnggngt
ncayacnttyccngcngtnmtncarwsnwsnggnmtntaywsnmtnwsnwsngtngtnacngtn
ccnwsnwsnaayttyggnacncaracntayacntgyaaygtngaycayaarccnwsnaayacna
argtngayaaracngtngarmgnaartgytgygtngartgyccnccntgyccngcnccnccngt
ngcnggnccnwsngtnttymtnttyccnccnaarccnaargayacnmtnatgathwsnmgnacn
ccngargtnacntgygtngtngtngaygtnwsncaygargayccngargtncarttyaaytggt
aygtngayggngtngargtncayaaygcnaaracnaarccnmgngargarcarttyaaywsnac
nttymgngtngtnwsngtnmtnacngtngtncaycargaytggmtnaayggnaargartayaar
tgyaargtnwsnaayaarggnmtnccngcnccnathgaraaracnathwsnaaracnaarggnc
arccnmgngarccncargtntayacnmtnccnccnwsnmgngargaratgacnaaraaycargt
nwsnmtnacntgymtngtnaarggnttytayccnwsngayathgcngtngartgggarwsnaay
ggncarccngaraayaaytayaaracnacnccnccnatgmtngaywsngayggnwsnttyttym
tntaywsnaarmtnacngtngayaarwsnmgntggcarcarggnaaygtnttywsntgywsngt
natgcaygargcnmtncayaaycaytayacncaraarwsnmtnwsnmtnwsnccnggnaar U<sub>H</sub>-56 heavy chain nucleotide sequence (SEQ ID NO:623)
gargtncarmtngtncarwsnggngcngargtnaaraarccnggngarwsnmtnaarathwsnt
gyaarggnwsnggntaywsnttyacnwsntaytggathggntgggtnmgncaratgccnggnaa
rggnmtngartggatgggnathathtayccggngaywsngayathmgntaywsnccnwsntty
carggncargtnacnathwsngcngayaarwsnathwsnacngcntaymtcartggwsnwsnm
tnaargcnwsngayacngcnatgtaytaytgygcnmgncarggnmtngcngtngcnggnacnws
ntaytaytaytaytayggnatggaygtntggggncarggnacnacngtnacngtnwsnwsngcn
wsnacnaarggnccnwsngtnttyccnmtngcnccntgywsnmgnwsnacnwsngarwsnacng
cngcnmtnggntgymtngtnaargaytayttyccngarccngtnacngtnwsntggaaywsngg
ngcnmtnacnwsnggngtncayacnttyccngcngtnmtncarwsnwsnggnmtntaywsnmtn
wsnwsngtngtnacngtnccnwsnwsnaayttyggnacncaracntayacntgyaaygtngayc
ayaarccnwsnaayacnaargtngayaaracngtngarmgnaartgytgygtngartgyccncc
ntgyccngcnccnccgtngcnggnccnwsngtnttymtnttyccnccnaarccnaargayacn
mtnatgathwsnmgnacnccngargtnacntgygtngtngtngaygtnwsncaygargayccng
argtncarttyaaytggtaygtngayggngtngargtncayaaygcnaaracnaarccnmgnga
rgarcarttyaaywsnacnttymgngtngtnwsngtnmtnacngtngtncaycargaytggmtn
aayggnaargartayaartgyaargtnwsnaayaarggnmtnccngcnccnathgaraaracna
thwsnaaracnaarggncarccnmgngarccncargtntayacnmtnccnccnwsnmgngarga
ratgacnaaraaycargtnwsnmtnacntgymtngtnaarggnttytayccnwsngayathgcn
gtngartgggarwsnaayggncarccngaraayaaytayaaracnacnccnccnatgmtngayw
sngayggnwsnttyttymtntaywsnaarmtnacngtngayaarwsnmgntggcarcarggnaa
ygtnttywsntgywsngtnatgcaygargcnmtncayaaycaytayacncaraarwsnmtnwsn
mtnwsnccnggnaar

FIGURE 14AB

U<sub>H</sub>-57 heavy chain nucleotide sequence (SEQ ID NO:624)
cargtncarmtncarcarwsnggnccnggnmtngtnaarccnwsncaracnmtnwsnmtnacnt
gygcnathwsnggngaywsngtnwsnwsntaywsngcngcntggaaytggathmgncarwsncc
nwsnmgnggnmtngartggmtnggnmgnacntaytgymgnwsnaartggtayaaygaytaygcn
gtnwsngtnaarwsnmgnathacnathaayccngayacnwsnaaraaycarttywsnmtncarm
tnaaywsngtnacnccngargayacngcngtntaytaytgygcnmgngaymgngcngtngcngg
ntaytaytayggnatggaygtntggggncarggnacnacngtnacngtnwsnwsngcnwsnacn
aarggnccnwsngtnttyccnmtngcnccntgywsnmgnwsnacnwsngarwsnacngcngcnm
tnggntgymtngtnaargaytayttyccngarccngtnacngtnwsntggaaywsnggngcnmt
nacnwsnggngtncayacnttyccngcngtnmtncarwsnwsnggnmtntaywsnmtnwsnwsn
gtngtnacngtnccnwsnwsnaayttyggnacncaracntayacntgyaaygtngaycayaarc
cnwsnaayacnaargtngayaaracngtngarmgnaartgytgygtngartgyccnccntgycc
ngcnccnccngtngcnggnccnwsngtnttymtnttyccnccnaarccnaargayacnmtnatg
athwsnmgnacnccngargtnacntgygtngtngtngaygtnwsncaygargayccngargtnc
arttyaaytggtaygtngayggngtngargtncayaaygcnaaracnaarccnmgngargarca
rttyaaywsnacnttymgngtngtnwsngtnmtnacngtngtncaycargaytggmtnaayggn
aargartayaartgyaargtnwsnaayaarggnmtnccngcnccnathgaraaracnathwsna
aracnaarggncarccnmgngarccncargtntayacnmtnccnccwsnmgngargaratgac
naaraaycargtnwsnmtnacntgymtngtnaarggnttytayccnwsngayathgcngtngar
tgggarwsnaayggncarccngaraayaaytayaaracnacnccnccnatgmtngaywsngayg
gnwsnttyttymtntaywsnaarmtnacngtngayaarwsnmgntggcarcarggnaaygtntt
ywsntgywsngtnatgcaygargcnmtncayaaycaytayacncaraarwsnmtnwsnmtnwsn
ccnggnaar U<sub>H</sub>-58 heavy chain nucleotide sequence (SEQ ID NO:604)
gargtncarmtngtngarwsnggnggnggnmtngtncarccnggnggnwsnmtnmgnmtnwsnt
gygcngcnwsnggnttyacnttywsngcntaywsnatgaaytgggtnmgncargcnccnggnaa
rggnmtngartgggtnwsntayathwsnwsnwsnggnmgnacnathtaytaygcngaywsngtn
aarggnmgnttyacnathwsnmgngayaaygcnaaraaywsnmtnttymtncaratgaaywsnm
tnmgngaygargayacngcngtntaytaytgygcnmtntgggcnccnttygaytaytggggnca
rggnacnmtngtnacngtnwsnwsngcnwsnacnaarggnccnwsngtnttyccnmtngcnccn
tgywsnmgnwsnacnwsngarwsnacngcngcnmtnggntgymtngtnaargaytayttyccng
arccngtnacngtnwsntggaaywsnggngcnmtnacnwsnggngtncayacnttyccngcngt
nmtncarwsnwsnggnmtntaywsnmtnwsnwsngtngtnacngtnccnwsnwsnaayttyggn
acncaracntayacntgyaaygtngaycayaarccnwsnaayacnaargtngayaaracngtng
armgnaartgytgygtngartgyccnccntgycngcnccnccngtngcnggnccnwsngtntt
ymtnttyccnccnaarccnaargayacnmtnatgathwsnmgnacnccngargtnacntgygtn
gtngtngaygtnwsncaygargayccngargtncarttyaaytggtaygtngayggngtngarg
tncayaaygcnaaracnaarccnmgngargarcarttyaaywsnacnttymgngtngtnwsngt
nmtnacngtngtncaycargaytggmtnaayggnaargartayaartgyaargtnwsnaayaar
ggnmtnccngcnccnathgaraaracnathwsnaaracnaarggncarccnmgngarccncarg
tntayacnmtnccnccwsnmgngargaratgacnaaraaycargtnwsnmtnacntgymtngt
naarggnttytayccnwsngayathgcngtngartgggarwsnaayggncarccngaraayaay
tayaaracnacnccnccnatgmtngaywsngayggnwsnttyttymtntaywsnaarmtnacng
tngayaarwsnmgntggcarcarggnaaygtnttywsntgywsngtnatgcaygargcnmtnca
yaaycaytayacncaraarwsnmtnwsnmtnwsnccnggnaar

FIGURE 14AC

U-V_L-1 light chain variable region nucleotide sequence (SEQ ID NO:625)
gaygtngtnatgcancarwsnccnytnwsnytnccngtncanytnggncarccngcnwsnathw
sntgymgnwsnwsncarwsnytngtntaywsngayggnaaycantayytnaaytggttycarca
rmgnccnggncarwsnccnmgnmgnytnathtayaargtnwsnaaytgggaywsnggngtnccn
gaymgnttyaayggnwsnggnwsnggncangayttycanytnaarathwsnmgngtngargcng
argaygtnggngtntaytaytgyatgcarwsncancaytggccnathcanttyggncarggnca
nmgnytngarathaar U-V_L-2 light chain variable region nucleotide sequence (SEQ ID NO:626)
gaygtngtnatgcancarwsnccnytnwsnytnccngtncanytnggncarccngcnwsnathw
sntgymgnwsnwsncarwsnytngtntaywsngayggnaaycantayytnaaytggttycarca
rmgnccnggncarwsnccnmgnmgnytnathtayaargtnwsnaaytgggaywsnggngtnccn
gaymgnttywsnggnwsnggnwsnggncangayttycanytnaarathwsnmgngtngargcng
argaygtnggngtntaytaytgyathcarggncancaytggccncancanttyggncarggnca
nmgnytngarathaar U-V_L-3 light chain variable region nucleotide sequence (SEQ ID NO:627)
gaygtngtnatgcancarwsnccnytnwsnytnccngtncanytnggncarccngcnwsnathw
sntgymgnwsnwsncarwsnytngtntaywsngayggnaaycantayytnaaytggytncarca
rmgnccnggncarwsnccnmgnmgnytnathtayaargtnwsnaaytgggaywsnggngtnccn
gaymgnttywsnggnwsnggnwsnggncangayttycanytnaarathwsnmgngtngargcng
argaygtnggngtntaytaytgyatgcarggncancaytggccnathcanttyggncarggnca
nmgnytngarathaar U-V_L-4 light chain variable region nucleotide sequence (SEQ ID NO:627)
gaygtngtnatgcancarwsnccnytnwsnytnccngtncanytnggncarccngcnwsnathw
sntgymgnwsnwsncarwsnytngtntaywsngayggnaaycantayytnaaytggytncarca
rmgnccnggncarwsnccnmgnmgnytnathtayaargtnwsnaaytgggaywsnggngtnccn
gaymgnttywsnggnwsnggnwsnggncangayttycanytnaarathwsnmgngtngargcng
argaygtnggngtntaytaytgyatgcarggncancaytggccnathcanttyggncarggnca
nmgnytngarathaar U-V_L-5 light chain variable region nucleotide sequence (SEQ ID NO:628)
Gayathgtnatgcancarcanccnytnwsnytnwsngtncanccnggncarccngcnwsnathw
sntgyaarwsnwsncarwsnytnytncaywsngayggnaarcantayytntaytggtayytnca
raarccnggncarccnccncarytnytnathtaygargtnwsnaaymgnttywsnggngtnccn
gaymgnttywsnggnwsnggnwsnggncangayttycanytnaarathwsnmgngtngargcng
argaygtnggngtntaytaytgyatgcarggnathcarytnccntgywsnttyggncarggnca
naarytngarathaar

FIGURE 15A

U-V$_L$-6 light chain variable region nucleotide sequence (SEQ ID NO:629)
gayathgtnatgcancarcanccnytnwsnytnwsngtncanccnggncarccngcnwsnathw
sntgyaarwsnwsncarwsnytnytncaywsngayggnaarcantayytntaytggtayytnca
raarccnggncarccnccncarytnytnathtaygargtnwsnaaymgnttywsnggngtnccn
gaymgnttywsnggnwsnggnwsnggncangayttycanytnaarathwsnmgngtngargcng
argaygtnggngtntaytaytgyatgcarwsnathcarytnccnytncanttyggnggnggnca
naargtngarathaar

U-V$_L$-7 light chain variable region nucleotide sequence (SEQ ID NO:629)
gayathgtnatgcancarcanccnytnwsnytnwsngtncanccnggncarccngcnwsnathw
sntgyaarwsnwsncarwsnytnytncaywsngayggnaarcantayytntaytggtayytnca
raarccnggncarccnccncarytnytnathtaygargtnwsnaaymgnttywsnggngtnccn
gaymgnttywsnggnwsnggnwsnggncangayttycanytnaarathwsnmgngtngargcng
argaygtnggngtntaytaytgyatgcarwsnathcarytnccnytncanttyggnggnggnca
naargtngarathaar

U-V$_L$-8 light chain variable region nucleotide sequence (SEQ ID NO:630)
gayathgtnatgcancarcanccnytnwsnytnwsngtncanccnggncarccngcnwsnathw
sntgyaarwsnwsncarwsnytnytncaywsngayggnaarcantayytntaytggttyytnca
raarccnggncarccnccncarccnytnathtaygargtnwsnaaymgnttywsnggngtnccn
gaymgnttywsnggnwsnggnwsnggncangayttycanytnaarathwsnmgngtngargcng
argaygtnggngtntaytaytgyatgcarwsnathcarytnccnathcanttyggncayggnca
nmgnytngarathaar

U-V$_L$-9 light chain variable region nucleotide sequence (SEQ ID NO:630)
gayathgtnatgcancarcanccnytnwsnytnwsngtncanccnggncarccngcnwsnathw
sntgyaarwsnwsncarwsnytnytncaywsngayggnaarcantayytntaytggttyytnca
raarccnggncarccnccncarccnytnathtaygargtnwsnaaymgnttywsnggngtnccn
gaymgnttywsnggnwsnggnwsnggncangayttycanytnaarathwsnmgngtngargcng
argaygtnggngtntaytaytgyatgcarwsnathcarytnccnathcanttyggncayggnca
nmgnytngarathaar

U-V$_L$-11 light chain variable region nucleotide sequence (SEQ ID NO:631)
gayathcaratgcancarwsnccnwsnwsnytnwsngcnwsngtnggngaymgngtncanathc
antgymgngcnwsncarggnathgcnaaytayytngcntggtaycarcaraarccnggnaargt
nccnaarytnytnathtaygtngcnwsncanytncarwsnggngtnccnwsnmgnttywsnggn
wsnggnwsnggncangayttycanytncanathwsnwsnytncarccngargaygtngcncant
aytaytgycaraaytayaaywsngcnccnttycanttyggnccnggncanaargtngayathaar

FIGURE 15B

U-V<sub>L</sub>-12 light chain variable region nucleotide sequence (SEQ ID NO:632)
gayathcaratgcancarwsnccnwsnwsnytnwsngcnwsngtnggngaymgngtncanatha
thtgymgngcnwsncarggnathwsnaaygayytngcntggtaycarcaraarccnggnaargt
nccnaarytnytnathtaygcngcnwsncanytncarwsnggngtnccnwsnmgnttywsnggn
wsnggnwsnggncangayttycanytncanathwsnwsnytncarccngargaygtngcncant
aytaytgycaraartayaaywsngtnccnytncanttyggnggnggncanaargtngarathaar

U-V<sub>L</sub>-13 light chain variable region nucleotide sequence (SEQ ID NO:633)
aayathgtnatgcancarcanccnytnwsnwsnccngtncanytnggncarccngcnwsnathw
sntgymgnwsnwsncarwsnytngtncaywsngayggnaaycantayytnwsntggytncarca
rmgnccnggncarccnccnmgnytnytnathtayaarathwsnaaymgnttywsnggngtnccn
gaymgnttywsnggnwsnggngcnggncangayttycanytnaarathwsnmgngtngargcng
argaygtnggngtntaytaytgyatgcargcncancarttyccncaycanttyggnccnggnca
naargtngayathaar

U-V<sub>L</sub>-14 light chain variable region nucleotide sequence (SEQ ID NO:633)
aayathgtnatgcancarcanccnytnwsnwsnccngtncanytnggncarccngcnwsnathw
sntgymgnwsnwsncarwsnytngtncaywsngayggnaaycantayytnwsntggytncarca
rmgnccnggncarccnccnmgnytnytnathtayaarathwsnaaymgnttywsnggngtnccn
gaymgnttywsnggnwsnggngcnggncangayttycanytnaarathwsnmgngtngargcng
argaygtnggngtntaytaytgyatgcargcncancarttyccncaycanttyggnccnggnca
naargtngayathaar

U-V<sub>L</sub>-15 light chain variable region nucleotide sequence (SEQ ID NO:634)
garathgtnatgcancarcanccnytnwsnwsnccngtncanytnggncarccngcnwsnathw
sntgymgnwsnwsncarwsnytngtncaywsngayggnaaycantayytnwsntggytncarca
rmgnccnggncarccnccnmgnytnytnathtayaarathwsnaaymgnttywsnggngtnccn
gaymgnttywsnggncanggngcnggncangayttycanytnaarathwsnmgngtngargcng
argaygtnggngtntaytaytgyatgcargcncancarttyccncaycanttyggnggnggnca
naargtngarathaar

U-V<sub>L</sub>-16 light chain variable region nucleotide sequence (SEQ ID NO:635)
garathgtnytncancarwsnccnggncanytnwsnytnwsnccnggngarmgngcncanytnw
sntgymgngcnwsncarcangtnathwsnwsntayytngcntggtaycarcaraarccnggnca
rgcnccnmgnytnytnathwsnggngcnwsnwsnmgngcncanggnathccngaymgnttywsn
ggnwsnggnwsnggncangayttycanytncanathwsnmgnytngarccngargayttygcng
tntaytaytgycarcartayggnwsnwsnccnmgncanttyggncarggncanaargtngarat
haar

FIGURE 15C

U-V<sub>L</sub>-17 light chain variable region nucleotide sequence (SEQ ID NO:636)
garathgtnytncancarwsnccnggncanytnwsnytnwsnccnggngarmgngcncanytnw
sntgymgngcnwsncarwsngtnwsnmgnytngcntggtaycarcaraarccnggncargcncc
nmgnytnytnathtayggngcnwsnmgnmgngcncanggnathccngaymgnttywsnggnwsn
ggnwsnggncangayttycanytncanathwsnmgnytngarccngargayttygcngtntayt
aytgycarcartayggnwsnwsnccnmgnwsnttyggncarggncanaarytngarathaar

U-V<sub>L</sub>-18 light chain variable region nucleotide sequence (SEQ ID NO:637)
gayathcaratgcancarwsnccnwsnwsnytnwsngcnwsngtnggngaymgngtncanathc
antgymgngcnwsncarggnathmgnaaygayytnggntggtaycarcaraarccnggnaargc
ccnaarmgnytnathtaygcgcnwsnwsnytncarwsnggngtnccnwsnmgnttywsnggn
wsnggnwsnggncangarttycanytncanathwsnwsnytncarccngargayttygcncant
aytaytgyytncarcayaaywsntayccnccncanttyggncarggncanaargtngarathaar

U-V<sub>L</sub>-19 light chain variable region nucleotide sequence (SEQ ID NO:638)
gayathgtnatgcancarwsnccngaywsnytngcngtnwsnytnggngarmgngcncanatha
aytgyaarwsnwsncarwsngtnytntaywsnwsnaayaayaaraaytayytngtntggtayca
rcaraarccnggncarccnccnaarytnttyathtaytgggcnwsncanmgngarwsnggngtn
ccngaymgnttycanggnwsnggnwsnggncangayttycanytncanathwsnwsnytncarg
cngargaygtngcngtntaytaytgycarcartaytaywsnttyccntggcanttyggncargg
ncanaargtngarathaar

U-V<sub>L</sub>-20 light chain variable region nucleotide sequence (SEQ ID NO:638)
gayathgtnatgcancarwsnccngaywsnytngcngtnwsnytnggngarmgngcncanatha
aytgyaarwsnwsncarwsngtnytntaywsnwsnaayaayaaraaytayytngtntggtayca
rcaraarccnggncarccnccnaarytnttyathtaytgggcnwsncanmgngarwsnggngtn
ccngaymgnttycanggnwsnggnwsnggncangayttycanytncanathwsnwsnytncarg
cngargaygtngcngtntaytaytgycarcartaytaywsnttyccntggcanttyggncargg
ncanaargtngarathaar

U-V<sub>L</sub>-21 light chain variable region nucleotide sequence (SEQ ID NO:639)
gayathgtnatgcancarwsnccngaywsnytngcngtnwsnytnggngarmgngcncanatha
aytgyaarwsnwsncarwsngtnytntaywsnwsnaayaayaaraaytayytngcntggtayca
rcaraarccnggncarccnccnaarytnytnathtaytgggcnwsncanmgngarwsnggngtn
ccngaymgnttywsnggnwsnggnwsnggncangayttycanytncanathwsnwsnytncarg
cngargaygtngcngtntaytaytgycarcartaytaywsncancantggcanttyggncargg
ncanaargtngarathaar

FIGURE 15D

U-V$_L$-22 light chain variable region nucleotide sequence (SEQ ID NO:640)
gayathgtnatgcancarwsnccngaywsnytngcngtnwsnytnggngarmgngcncanatha
aytgyaarwsnwsncaraaygtnytntaywsnwsnaayaayaaraaytayytngcntggtayca
rcaraarccnggncarccnccnaarytnytnathtaytgggcnwsncanmgngarwsnggngtn
ccngaymgnttywsnggnwsnggnwsnggncangayttycanytncanathwsnwsnytncarg
cngargaygtngcngtntayttytgycarcartaytayggncanccnmgncanttyggncargg
ncanaargtngarathaar

U-V$_L$-23 light chain variable region nucleotide sequence (SEQ ID NO:641)
gayathgtnatgcancarwsnccngaywsnytngcngtnwsnytnggngarmgngcncanatha
aytgyaarwsnwsncaraaygtnytntaywsnwsnaayaayaaraaytayytngcntggtayca
rcaraarccnggncarccnccnaarytnytnathtaytgggcnwsncanmgngarwsnggngtn
ccngaymgnttywsnggnwsnggnwsnggncangayttycanytncanathwsnwsnytncarg
cngargaygtngcngtntayttytgycarcartaytayggncanccnmgncanttyggncargg
ncanaargtngarathaar

U-V$_L$-24 light chain variable region nucleotide sequence (SEQ ID NO:642)
gayathgtnatgcancarwsnccngaywsnytncangtnwsnytnggngarmgngcncanatha
aytgyaarwsnwsncarwsngtnytntaywsnwsnaayaayaaraaytayytngcntggtayca
rcaraarccnggncarccnccnaarytnytnathtaytgggcnwsncanmgngarwsnggngtn
ccngaymgnttyggnggnwsnggnwsnggncangayttycanytncanathwsnwsnytncarg
cngargaygtngcngtntaytaytgycarcartaytaywsnathwsnmgncanttyggncargg
ncanaargtngarathaar

U-V$_L$-25 light chain variable region nucleotide sequence (SEQ ID NO:642)
gayathgtnatgcancarwsnccngaywsnytncangtnwsnytnggngarmgngcncanatha
aytgyaarwsnwsncarwsngtnytntaywsnwsnaayaayaaraaytayytngcntggtayca
rcaraarccnggncarccnccnaarytnytnathtaytgggcnwsncanmgngarwsnggngtn
ccngaymgnttyggnggnwsnggnwsnggncangayttycanytncanathwsnwsnytncarg
cngargaygtngcngtntaytaytgycarcartaytaywsnathwsnmgncanttyggncargg
ncanaargtngarathaar

U-V$_L$-26 light chain variable region nucleotide sequence (SEQ ID NO:643)
gayathgtnatgcancarwsnccngaywsnytngcngtnwsnytnggngarmgngcncanatha
aytgyaarwsnwsncarwsngtnytntayaaywsnaayaayaaraaytayytngcntggtayca
rcaraarccnggncarccnccnaarytnytnathtaytgggcnwsncanmgngarwsnggngtn
ccngaymgnttywsnggnwsnggnwsnggncangayttycanytncanathwsnwsnytncarg
cngaygaygtngcngtntaytaytgycarcartaytaywsncancantggcanttyggnccngg
ncanaargtngarathaar

FIGURE 15E

U-V<sub>L</sub>-27 light chain variable region nucleotide sequence (SEQ ID NO:644)
gayathgtnatgcancarwsnccngaywsnytngcngtnwsnytnggngarmgngcncanatha
aytgyaarwsnwsncarwsngtnytntayaaywsnaayaayaaraaytayytngcntggtayca
rcaraarccnggncarccnccnaarytnytnathtaytgggcnwsncanmgngarwsnggngtn
ccngaymgnttywsnggnwsnggnwsnggncangayttycanytncanathwsnwsnytncarg
cngaygaygtngcngtntaytaytgycarcartaytaywsncancantggcanttyggnccngg
ncanaargtngarathaar

U-V<sub>L</sub>-28 light chain variable region nucleotide sequence (SEQ ID NO:645)
gayathgtnatgcancarwsnccngaywsnytngcngtnwsnytnggngarmgngcncanatha
aytgyaarwsnwsncarwsngtnytntaywsnwsnaayaayaaraaytayytngcntggtayca
rcaraarccnggncarccnccnaargtnytnathtaytgggcnwsncanmgnaarwsnggngtn
ccngaymgnttywsnggnwsnggnwsnggncangayttycanytncanathwsnggnytncarg
cngargaygtngcnytntaytaytgycarcartaytaywsncanatgttywsnttyggncargg
ncanaarytngarathaar

U-V<sub>L</sub>-29 light chain variable region nucleotide sequence (SEQ ID NO:645)
gayathgtnatgcancarwsnccngaywsnytngcngtnwsnytnggngarmgngcncanatha
aytgyaarwsnwsncarwsngtnytntaywsnwsnaayaayaaraaytayytngcntggtayca
rcaraarccnggncarccnccnaargtnytnathtaytgggcnwsncanmgnaarwsnggngtn
ccngaymgnttywsnggnwsnggnwsnggncangayttycanytncanathwsnggnytncarg
cngargaygtngcnytntaytaytgycarcartaytaywsncanatgttywsnttyggncargg
ncanaarytngarathaar

U-V<sub>L</sub>-30 light chain variable region nucleotide sequence (SEQ ID NO:646)
gayathgtnatgcancarwsnccngaywsnytngcngtnwsnytnggngarmgngcncanatha
aytgyaarwsnwsncarwsngtnytngaywsnwsnaayaayaaraaytayytngcntggtayca
rcaraarccnggncarccnccnaarytnytnathtaytgggcnwsncanmgngarwsnggngtn
ccngaymgnttywsnggnwsnggnwsnggncangayttycanytncanathwsnwsnytncarg
cngargaygtngcngtnttytaytgycaycartaytaywsncanccnytncanttyggnggngg
ncanaargtngcnathaar

U-V<sub>L</sub>-31 light chain variable region nucleotide sequence (SEQ ID NO:646)
gayathgtnatgcancarwsnccngaywsnytngcngtnwsnytnggngarmgngcncanatha
aytgyaarwsnwsncarwsngtnytngaywsnwsnaayaayaaraaytayytngcntggtayca
rcaraarccnggncarccnccnaarytnytnathtaytgggcnwsncanmgngarwsnggngtn
ccngaymgnttywsnggnwsnggnwsnggncangayttycanytncanathwsnwsnytncarg
cngargaygtngcngtnttytaytgycaycartaytaywsncanccnytncanttyggnggngg
ncanaargtngcnathaar

FIGURE 15F

U-V<sub>L</sub>-32 light chain variable region nucleotide sequence (SEQ ID NO:647)
gayathgtnatgcancarwsnccngaywsnytngcngtnwsnytnggngarmgngcncanatha
aytgyaarwsnwsncarwsnathytntaymgnwsnaayaayaaraaytayytngcntggtayca
rcaraarccnggncarccnccnaarytnytnathtaytgggcnwsngcnmgngarwsnggngtn
ccngaymgnttywsnggnwsnggnwsnggncangayttycanytncanathwsnwsnytncarg
cngargaygtngcngtntayttytgycarcartayttyathcanccnytncanttyggnggngg
ncanaargtngarathaar

U-V<sub>L</sub>-33 light chain variable region nucleotide sequence (SEQ ID NO:647)
gayathgtnatgcancarwsnccngaywsnytngcngtnwsnytnggngarmgngcncanatha
aytgyaarwsnwsncarwsnathytntaymgnwsnaayaayaaraaytayytngcntggtayca
rcaraarccnggncarccnccnaarytnytnathtaytgggcnwsngcnmgngarwsnggngtn
ccngaymgnttywsnggnwsnggnwsnggncangayttycanytncanathwsnwsnytncarg
cngargaygtngcngtntayttytgycarcartayttyathcanccnytncanttyggnggngg
ncanaargtngarathaar

U-V<sub>L</sub>-34 light chain variable region nucleotide sequence (SEQ ID NO:648)
gayathcaratgcancarwsnccnwsnwsnytnwsngcnwsngtnggngaymgngtncanathc
antgymgngcnwsncargayathwsncaytayytngcntggttycarcaraarccnggnaargc
nccnaarwsnytnathtaygcngcnwsnwsnytncarwsnggngtnccnwsnaarttywsnggn
wsnggnwsnggncangayttycanytncanathwsnwsnytncarccngargayttygcncant
aytaytgycarcartayaayaaytayccnttycanttyggnccnggncanaargtngayathaar

U-V<sub>L</sub>-35 light chain variable region nucleotide sequence (SEQ ID NO:649)
gayathcaratgcancarwsnccnwsnwsnytnwsngcnwsngtnggngaymgngtngcnathc
antgymgngcnwsncargayathwsnaaytayytngcntggytncarcaraarccnggnaargc
nccnaarwsnytnathtaygcngcnwsnwsnytncarwsnggngtnccnwsnmgnttywsnggn
wsnggnwsnggncangayttycanytncanathwsnwsnytncarccngargayttygcncant
aytaytgycarcartayaaycantayccnttycanttyggnccnggncanaaratggayathaar

U-V<sub>L</sub>-36 light chain variable region nucleotide sequence (SEQ ID NO:650)
garathgtnatgcancarwsnccngcncanytnwsngtnwsnccnggngarmgngcncanytnw
sntgymgngcnwsncarwsngtnwsnwsnaayytngcntggtaycarcargayccnggncargc
nccnmgnytnytnathtayggngcnwsnmgnmgngcncanggnathccngcnmgnttywsnggn
wsnggnwsnggncangarttycanytncanathwsnwsnytncarwsngargayttygcngtnt
aytaytgycarcarcayaayaaytggccnccntggcanttyggncarggncanaargtngarat
haar

FIGURE 15G

U-V<sub>L</sub>-37 light chain variable region nucleotide sequence (SEQ ID NO:650)
garathgtnatgcancarwsnccngcncanytnwsngtnwsnccnggngarmgngcncanytnw
sntgymgngcnwsncarwsngtnwsnwsnaayytngcntggtaycarcargayccnggncargc
nccnmgnytnytnathtayggngcnwsnmgnmgngcncanggnathccngcnmgnttywsnggn
wsnggnwsnggncangarttycanytncanathwsnwsnytncarwsngargayttygcngtnt
aytaytgycarcarcayaayaaytggccnccntggcanttyggncarggncanaargtngarat
haar

U-V<sub>L</sub>-38 light chain variable region nucleotide sequence (SEQ ID NO:651)
Gayathcaratgcancarwsnccnwsnwsngtnwsngcnwsngtnggngaymgngtncanathc
antgymgngcnwsncargayathwsnmgntggytngcntggtaycarcaraarccnggnaargc
nccnaarytnytnathtaygcngcnwsnwsnytncarwsnggngtnccnwsnmgnttywsnggn
wsnggnwsnggncangayttycanytncanathwsnwsnytncarccngargayttygcncant
aytaytgycarcargcnaaywsnttyccnccncanttyggncarggncanaargtngarttyaar

U-V<sub>L</sub>-39 light chain variable region nucleotide sequence (SEQ ID NO:652)
gayathcaratgcancarwsccnwsnwsnytnwsngcnwsngtnggngaymgngtncanathc
antgymgngcnwsncarwsnathwsncantayytnaaytggtaycarcaraarccnggnaargc
nccnaarttyytnathtaygcngcnwsnwsnytncarwsnggngtnccnwsnmgnttywsnggn
wsnggnwsnggncangayttycanytncanathwsnwsnytncarccngargayttygcngcnt
aytaytgycarcarwsncaywsngcnccnttycanttyggccnggncanaargtngayathaar

U-V<sub>L</sub>-40 light chain variable region nucleotide sequence (SEQ ID NO:653)
gayathcaratgcancarwsccnwsnwsnytnwsngcnwsnytnggngaymgngtncanathc
antgymgngcnwsncarcanathwsnathtayytnaaytggtaycarcaraarccnggnaargc
nccnaarytnytnathtaygcngcnwsnwsnytncarwsnggngtnccnwsnmgnttywsnggn
wsnggnwsnggncangayttycanytncanathwsnwsnytncarccngargayttygcncant
aytaytgycarcarwsntaywsncanytncanttyggnggnggncanaargtngarathaar

U-V<sub>L</sub>-41 light chain variable region nucleotide sequence (SEQ ID NO:654)
gayathcaratgcancarwsccnwsnwsnytnwsngcnwsngtnggngaymgngtncanathc
antgymgngcnwsncarwsnathmgnwsntayytnaaytggtaycarcarmgnccnggnaaygc
nccnaarytnytnathtaygcngcnwsnwsnytncarwsnggngtnccnwsnmgntnwsnggn
wsnggnwsnggncangayttycanytncanathmgnwsnytncarccngargayttygcncant
aytaytgycarcarwsntaywsnathccnytncanttyggnggnggncanaargtngarathaar

FIGURE 15H

U-V<sub>L</sub>-42 light chain variable region nucleotide sequence (SEQ ID NO:655)
gayathcaratgcancarwsnccnwsnwsnmgnwsngcnwsngtnggngaymgngtncanathc
antgymgngcnwsncarcanathwsnmgntayytnaaytggtaycarcaraarccnggnaargc
ccnaarytnytnathtaygcngcnwsncanytncarwsnggngtnccnwsnmgnttywsnggn
wsnggnwsnggncangayttycanytncanytnwsnwsnytncarccngargayttygcncant
aytaytgycarcarathtaywsncanwsnathcanttyggncarggncanmgnytngarathaar

U-V<sub>L</sub>-43 light chain variable region nucleotide sequence (SEQ ID NO:656)
Gayathcaratgcancarwsnccnwsnwsnytnwsngcnwsngtnggngaymgngtncanathc
antgymgngcnwsncarmgnathwsnwsntayytnaaytggtaycarcaraarccnggnaargc
ccnaargtnytnathtaygcngarwsnwsnytncarwsnggngtnccnwsnmgnttywsnggn
wsnggnwsnggncangayttycanytncanathwsnwsnytncarccngargayttygcncant
aytaytgycarcarwsntayathcanccnathcanttyggncarggncanmgnytngarathath

U-V<sub>L</sub>-44 light chain variable region nucleotide sequence (SEQ ID NO:657)
gayathcaratgcancarwsnccnwsnwsnytnwsngcnwsngtnggngaymgngtncanathc
antgymgngcnwsncarwsnathwsnmgntayytnaaytggtaycarcaraarccnggnaargc
ccnaarytnytnathtaycangcnwsnwsnytncarwsnggngtnccnwsnmgnttywsnggn
wsnggnwsnggncangayttycanytncanathwsnwsnytncarccngaraayttygcncant
aytaytgycarcarwsntayttycanccnathcanttyggncarggncanmgnytngarathaar

U-V<sub>L</sub>-45 light chain variable region nucleotide sequence (SEQ ID NO:658)
gayathcaratgcancarwsnccnwsnwsnytnwsngcnwsngtnggngaymgngtncanathc
antgymgngcnwsncarwsnathwsnwsntayytnaaytggtaycarcaraarccnggnaargc
ccnaarytnytnathtaycangcnwsnwsnytncarwsnggngtnccnwsnmgnttywsnggn
wsnggnwsnggncangayttycanytncanttywsnwsnytncarccngargayttygcncant
aytaytgycarcarwsntayttywsnccnathcanttyggncarggncanmgnytngarathaar

U-V<sub>L</sub>-46 light chain variable region nucleotide sequence (SEQ ID NO:659)
gayathcaratgcancarwsnccnwsnwsnytnwsngcnwsngtnggngaymgngtncanathc
antgymgngcnwsncarwsnathwsnwsntayytnaaytggtaycarcaraarccnggnaargc
ccnaarytnytnathtaycangcnwsnwsnytncarwsnggngtnccnwsnmgnttywsnggn
wsnggnwsnggncangayttycanytncanytnwsnwsnytncarccngargayttygcnwsnt
aytaytgycarcarwsnttytaycanccnathcanttyggncarggncanmgnytngarathaar

FIGURE 15I

U-V_L-47 light chain variable region nucleotide sequence (SEQ ID NO:659)
gayathcaratgcancarwsnccnwsnwsnytnwsngcnwsngtnggngaymgngtncanathc
antgymgngcnwsncarwsnathwsnwsntayytnaaytggtaycarcaraarccnggnaargc
ncnaarytnytnathtaycangcnwsnwsnytncarwsnggngtnccnwsnmgnttywsnggn
wsnggnwsnggncangayttycanytncanytnwsnwsnytncarccngargayttygcnwsnt
aytaytgycarcarwsnttytaycanccnathcanttyggncarggncanmgnytngarathaar

U-V_L-48 light chain variable region nucleotide sequence (SEQ ID NO:660)
gayathcaratgcancarwsnccnwsnwsnytnwsngcnwsngtnggngaymgngtncanathc
antgymgngcnwsncarwsnathwsnwsntayytnaaytggtaycarcaraarccnggnaargc
ncnaarytnytnathtaycangtnwsnwsnytncarwsnggngtnccnwsnmgnttywsnggn
wsnggnwsnggncangayttycanytncanathwsnwsnytncarccngargayttygcncant
aytaytgycarcarwsntayttycanccnathcanttyggncarggncanmgnytngarathaar

U-V_L-49 light chain variable region nucleotide sequence (SEQ ID NO:660)
gayathcaratgcancarwsnccnwsnwsnytnwsngcnwsngtnggngaymgngtncanathc
antgymgngcnwsncarwsnathwsnwsntayytnaaytggtaycarcaraarccnggnaargc
ncnaarytnytnathtaycangtnwsnwsnytncarwsnggngtnccnwsnmgnttywsnggn
wsnggnwsnggncangayttycanytncanathwsnwsnytncarccngargayttygcncant
aytaytgycarcarwsntayttycanccnathcanttyggncarggncanmgnytngarathaar

U-V_L-50 light chain variable region nucleotide sequence (SEQ ID NO:660)
gayathcaratgcancarwsnccnwsnwsnytnwsngcnwsngtnggngaymgngtncanathc
antgymgngcnwsncarwsnathwsnwsntayytnaaytggtaycarcaraarccnggnaargc
ncnaarytnytnathtaycangtnwsnwsnytncarwsnggngtnccnwsnmgnttywsnggn
wsnggnwsnggncangayttycanytncanathwsnwsnytncarccngargayttygcncant
aytaytgycarcarwsntayttycanccnathcanttyggncarggncanmgnytngarathaar

U-V_L-51 light chain variable region nucleotide sequence (SEQ ID NO:661)
gayathcaratgcancarwsnccnwsnwsnytnwsngcnwsngtnggngaymgngtncanathc
antgymgngcnwsncarwsnathwsnwsntayytnaaytggtaycarcaraarccnggnaargc
ncnaarytnytnathtaycangcnwsnwsnytncarwsnggngtnccnwsnmgnttywsnggn
wsnggnwsnggncangayttycanytncanathwsnwsnytncarccngargayttygcnwsnt
aytaytgycarcarwsnttytaygcnccnathcanttyggncarggncanmgnytngarathaar

FIGURE 15J

U-V$_L$-52 light chain variable region nucleotide sequence (SEQ ID NO:661)
gayathcaratgcancarwsnccnwsnwsnytnwsngcnwsngtnggngaymgngtncanathc
antgymgngcnwsncarwsnathwsnwsntayytnaaytggtaycarcaraarccnggnaargc
nccnaarytnytnathtaycangcnwsnwsnytncarwsnggngtnccnwsnmgnttywsnggn
wsnggnwsnggncangayttycanytncanathwsnwsnytncarccngargayttygcnwsnt
aytaytgycarcarwsnttytaygcnccnathcanttyggncarggncanmgnytngarathaar

U-V$_L$-53 light chain variable region nucleotide sequence (SEQ ID NO:662)
gayathcaratgcancarwsnccnwsnwsnytnwsngcnwsngtnggngaymgngtncanathc
antgymgngcnwsncarwsnathwsnwsntayytnaaytggtaycarcaraarccnggnaargc
nccnaarytnytnathtaycangcnwsnwsnytncarwsnggngtnccnwsnmgnttywsnggn
wsnggnwsnggncangayttycanytncanathwsnwsnytncarccngargayttygcncant
aytaytgycarcarwsntayttycanccnathcanttyggncarggncanmgnytngarathaar

U-V$_L$-54 light chain variable region nucleotide sequence (SEQ ID NO:663)
gayathcaratgcancarwsnccnwsnwsnytnwsngcnwsngtnggngaymgngtncanathc
antgycargcnwsncargayathwsnaaytayytnaaytggtaycarcaraarccnggnaargc
nccnaarytnytnathtaygaygcnwsnaayytngarcanggngtnccnwsnmgnttywsnggn
wsnggnwsnggncangayttycanttycanathwsnwsnytncarccngargayathgcncant
aytaytgycarcartaygaytayytnccnttycanttyggnccnggncanaargtngayathaar

U-V$_L$-55 light chain variable region nucleotide sequence (SEQ ID NO:663)
gayathcaratgcancarwsnccnwsnwsnytnwsngcnwsngtnggngaymgngtncanathc
antgycargcnwsncargayathwsnaaytayytnaaytggtaycarcaraarccnggnaargc
nccnaarytnytnathtaygaygcnwsnaayytngarcanggngtnccnwsnmgnttywsnggn
wsnggnwsnggncangayttycanttycanathwsnwsnytncarccngargayathgcncant
aytaytgycarcartaygaytayytnccnttycanttyggnccnggncanaargtngayathaar

U-V$_L$-56 light chain variable region nucleotide sequence (SEQ ID NO:664)
gayathcaratgcancarwsnccnwsnwsnytnwsngcnwsngtnggngaymgngtncanathc
antgycargcnwsncargayathwsnaaywsnytnaaytggtaycarcaraarccnggnaargc
nccngarytnytnathtaygaygcnwsnaayytngarcanggngtnccnwsnmgnttywsnggn
wsnggnwsnggncangayttycanttycanathwsnwsnytncarccngargayathgcncant
aytaytgycarcartgygaygayytnccnytncanttyggnggnggncanaargtngarathaar

FIGURE 15K

U-V<sub>L</sub>-57 light chain variable region nucleotide sequence (SEQ ID NO:665)
gayathcaratgcancarwsnccnwsnwsnytnwsngcnwsngtnggngaymgngtncanathc
antgycargcnwsncargayathwsngaytayytnaaytggtaycarcaraarccnggnaargc
ncсnaarytnytnathtaygaygcnwsnaayytngarcanggngtnccnwsnmgnttywsnggn
wsnggnwsnggncangayttycanttycanathwsnwsnytncarccngargayathgcncant
aytaytgycarcaytaygayaayytnccnytncanttyggnggnggncanaargtngarathaar

U-V<sub>L</sub>-58 light chain variable region nucleotide sequence (SEQ ID NO:666)
gayathcaratgcancarwsnccnwsnwsnytnwsngcnwsngtnggngaymgngtngcnathc
antgycargcnwsncargayathwsnaaytayytnaaytggtaycarcaraarccnggnaargc
ncсnaarytnytnathtaygaygcnwsnaayytngarcanggngtnccnwsnmgnttywsnggn
wsnggnwsnggncangayttycanttycanathwsnwsnytncarccngargayathgcncant
aytaytgycarcartaygayaayytnccnytncanttyggnggnggncanaargtngarathaar

U-V<sub>L</sub>-59 light chain variable region nucleotide sequence (SEQ ID NO:666)
gayathcaratgcancarwsnccnwsnwsnytnwsngcnwsngtnggngaymgngtngcnathc
antgycargcnwsncargayathwsnaaytayytnaaytggtaycarcaraarccnggnaargc
ncсnaarytnytnathtaygaygcnwsnaayytngarcanggngtnccnwsnmgnttywsnggn
wsnggnwsnggncangayttycanttycanathwsnwsnytncarccngargayathgcncant
aytaytgycarcartaygayaayytnccnytncanttyggnggnggncanaargtngarathaar

U-V<sub>L</sub>-60 light chain variable region nucleotide sequence (SEQ ID NO:667)
gayathcaratgcancarwsnccnwsnwsnytnwsngcnwsngtnggngaymgngtncanathc
antgycargcnwsncargayathwsnaaywsnytnaaytggtaycarcaraarccnggnaargc
ncсnaarytnytnathtaygaygcnwsnathytngarcanggngtnccnwsnmgnttywsnggn
wsnggnwsngarcangayttycanttycanathwsnwsnytncarccngargayathgcncant
aytaytgycarcartgygayathytnccnytnwsnttyggnggnggncanaargtngarathaar

U-V<sub>L</sub>-61 light chain variable region nucleotide sequence (SEQ ID NO:668)
Gayathcaratgcancarwsnccnwsnwsnytnwsngcnwsngtnggngaymgngtncanathc
antgycargcnwsncargayathwsnaaywsnytnaaytggtaycarcaraarccnggnaargc
ncсnaarytnytnathtaygaygcnwsnaayytngarcanggngtnccnwsnmgnttywsnggn
wsnggnwsnggncangayttycanttycanathwsnwsnytncarccngargayathgcncant
aytaytgycarcartaygayaayytnccnytngcnttyggnggnggncanaargtngarathmgn

FIGURE 15L

U-V_L-62 light chain variable region nucleotide sequence (SEQ ID NO:669)
gayathcaratgcancarwsnccnwsnwsnytnwsngcnwsngtnggngayggngtncanathc
antgycargcnwsncargayathcanaaytayytnaaytggtaycarcaraarccnggnaargc
nccnaarytnytnathtaygaygcnwsnaayytngarcanggngtnccnwsnmgnttywsnggn
wsnggnwsnggncangayttycanttycanathwsnwsnytncarccngargayathgcncant
aytaytgycarcartaygaywsnytnccnathcanttyggncarggncanmgnytngarathaar U-V_L-63 light chain variable region nucleotide sequence (SEQ ID NO:670)
gayathcaratgcancarwsnccnwsnwsnytnwsngcnwsngtnggngaymgngtncanathc
antgycargcnwsncargayathwsnaaytayytnaaytggtaycarcaraarytnggnaargc
nccnaarytnytnathcaygaygcnwsnaayytngarcanggngtnccnwsnmgnttywsnggn
wsnggnwsnggncangayttycanttycanathwsnwsnytncarccngargayathgcncant
aytaytgycarcartaygayaayytnccnathcanttyggncarggncanmgnytngarathaar U-V_L-64 light chain variable region nucleotide sequence (SEQ ID NO:671)
gayathcaratgcancarwsnccnwsnwsnytnwsngcnwsngtnggngaymgngtncanathc
antgycargcnwsncargayathwsngaytayytnaaytggtaycarcaraarccnggnaargc
nccnaarytnytnathtaygaygcnwsnaayytngarcanggngtnccnwsnmgnttywsnggn
wsnggnwsnggncangayttycanttycanathwsnwsnytncarccngargayathgcncant
aytaytgycarcaytaygayaayytnccnathcanttyggncarggncanmgnytngarathaar U-V_L-65 light chain variable region nucleotide sequence (SEQ ID NO:672)
gayathcaratgcancarwsnccnwsnwsnytnwsngcnwsngtnggngaymgngtncanathc
antgycargcnwsncargayathwsnaaywsnytnaaytggtaycarcaraarccnggnaargc
nccnaarytnytnathtaygaygcnwsnaayytngarcanggngtnccnwsnmgnttywsnggn
wsnggnwsnggncangayttycanttycanathwsnwsnytncarccngargayathgcncant
aytaytgycarcaytaygayaayytnccnathcanttyggncarggncanmgnytngarathaar

FIGURE 15M

U-V_H-1 heavy chain variable region nucleotide sequence (SEQ ID NO:673)
cargtncarytngtncarwsnggngcngargtnaaraarccnggngcnwsngtnaargtnwsnt
gyaargcnwsnggntaycanttycanwsntayggnathwsntgggtnmgncargcnccnggnca
rggnytngartggatgggntggathwsngcnwsnaayggnaaycanaaytaygcncaraarytn
cargaymgngtncanatgcancangaycanwsncanwsncangcntayatggarytnmgnwsny
tnmgnwsngaygaycangcngtntaytaytgygcnmgngargayaaytggaaytayggnttytt
ygaytaytggggncarggncanytngtncangtnwsnwsn U-V_H-2 heavy chain variable region nucleotide sequence (SEQ ID NO:673)
cargtncarytngtncarwsnggngcngargtnaaraarccnggngcnwsngtnaargtnwsnt
gyaargcnwsnggntaycanttycanwsntayggnathwsntgggtnmgncargcnccnggnca
rggnytngartggatgggntggathwsngcnwsnaayggnaaycanaaytaygcncaraarytn
cargaymgngtncanatgcancangaycanwsncanwsncangcntayatggarytnmgnwsny
tnmgnwsngaygaycangcngtntaytaytgygcnmgngargayaaytggaaytayggnttytt
ygaytaytggggncarggncanytngtncangtnwsnwsn U-V_H-3 heavy chain variable region nucleotide sequence (SEQ ID NO:674)
cargtncayytngtncarwsnggngcngargtnaaraarccnggngcnwsngtnaargtnwsnt
gyaargtnwsnggntaycanttycanggncaytayatgcaytgggtnmgncargcnccnggnca
rggnytngartggatgggntggathaayccnaaywsnggnggncanaaytgygcncaraartty
carggnmgngtncanatgcanmgngaycanwsnathwsncangcntayatggarytnwsnmgny
tnmgnwsngaygaycangcngtntaytaytgygcnmgnwsnathgcngtngcnytngaytaytg
gggncarggncanytngtncangtnwsnwsn U-V_H-4 heavy chain variable region nucleotide sequence (SEQ ID NO:675)
cargtncarytngtncarwsnggngcngargtnaaraarccnggngcnwsngtnaargtnwsnt
gyaargcnwsnggntaycanttycanggntaytayatgcaytgggtnmgncargcnccnggnca
rggnytngartggatgggntggathaayccnaaywsnggnggncanaaycaycancaraartty
carggnmgngtncanatgcanmgngaycanwsnathwsncangcntayatggarytnwsnmgny
tnmgnwsngaygaycangcngtntaytaytgygcnmgnwsnathgcngtngcnytngaytaytg
gggncarggncanytngtncangtnwsnwsn U-V_H-5 heavy chain variable region nucleotide sequence (SEQ ID NO:676)
cargtncarytngtncarwsnggngcngargtnmgnaarccnggngcnwsngtnaargtnwsnt
gyaargtnwsnggntaycanytncangarytnwsntgcaytgggtnmgncargcnccnggnaa
rggnytngartggatgggnwsnttygayccngargayggngarcanathtaygcncaraartty
carggnmgngtncanatgytngargaycanwsncangaycangcntayatggarytnwsnwsny
tnmgnwsngargaycangcngtntaytaytgygcncangarggngayggnggntaytaytayta
yggnatggaygtntggggncarggncancangtncangtnwsnwsn

FIGURE 16A

U-V<sub>H</sub>-6 heavy chain variable region nucleotide sequence (SEQ ID NO:676)
cargtncarytngtncarwsnggngcngargtnmgnaarccnggngcnwsngtnaargtnwsnt
gyaargtnwsnggntaycanytncangarytnwsnatgcaytgggtnmgncargcnccnggnaa
rggnytngartggatgggnwsnttygayccngargayggngarcanathtaygcncaraartty
carggnmgngtncanatgytngargaycanwsncangaycangcntayatggarytnwsnwsny
tnmgnwsngargaycangcngtntaytaytgygcncangarggngayggnggntaytaytayta
yggnatggaygtntggggncarggncancangtncangtnwsnwsn U-V<sub>H</sub>-7 heavy chain variable region nucleotide sequence (SEQ ID NO:677)
cargtncanytnaargarwsnggnccngtnytngtnaarccncangarcanytncanytncant
gycangtnwsnggnttywsnytnwsnaaygcnmgnatgggngtnwsntggathmgncarccncc
nggnaargcnytngartggytngcncayathttywsnaaygaygaraarwsntaywsncanwsn
ytnaarwsnmgnytncanathwsnaargaycanwsnaarwsncargtngtnytncanatgcana
ayatggayccngtngaycangcncantaytaytgygcnmgnatgtaywsnwsnggntggtaygg
ngtnttygaytaytggggncarggncanytngtncangtnwsnwsn U-V<sub>H</sub>-8 heavy chain variable region nucleotide sequence (SEQ ID NO:678)
cargtncanytnaargarwsnggnccngtnytngtnaarccncangarcanytncanytncant
gycangtnwsnggnttywsnytnwsnaaygcnmgnatgggngtnwsntggathmgncarccncc
nggnaargcnytngartggytngtnytnathttywsnaaygaygaraarwsntaywsncanwsn
ytnaarwsnmgnytncanathwsnaargaycanwsnaarwsncargtngtnytncanatgcana
ayatggayccngtngaycangcncantaytaytgygcnmgngtntaywsnwsnggntggwsntt
ytayggnatggaygtntggggncarggncancangtncangtnwsnwsn U-V<sub>H</sub>-9 heavy chain variable region nucleotide sequence (SEQ ID NO:679)
carathcanytnaargarwsnggnccncanytngtnaarccncancarcanytncanytncant
gycanttywsnggnttywsnytnwsncanggnggngtnggngtnggntggathmgncarccncc
nggnaargcnytngartggytngcnytnathtaytggaaygaygayaarmgntaywsnccnwsn
ytnaarwsnmgnytncanathcanaargaycanwsnaaraaycargtngtnytncanatgcana
ayatggayccngtngaycangcncantaytaytgygcncaymgnmgngarytnccnttygayta
ytggggncarggncanytngtncangtnwsnwsn U-V<sub>H</sub>-10 heavy chain variable region nucleotide sequence (SEQ ID NO:680)
carathcanytnaargarwsnggnccncanytngtnaarccncancarcanytncanytncant
gycanttywsnggnttywsnytnwsncanggnggngtnggngtnggntggathmgncarccncc
nggnaargcnytngartggytngcnytnathtaytggaaygaygayaarmgntaywsnccnwsn
ytnaarwsnmgnytncanathcanaargaycanwsnaarcancargtngtnytncangtncang
ayatggayccngtngaycangcncantaytaytgygcncaymgnaaytggcanccnttygayta
ytggggncarggncanytngtncangtnwsnwsn

FIGURE 16B

U-V<sub>H</sub>-11 heavy chain variable region nucleotide sequence (SEQ ID NO:681)
carathcanytnaargarwsnggnccncanytngtnaarccncancarcanytncanytncant
gycanttywsnggnttywsnytnaaycanggnggngtnggngtnggntggathmgncarccnc
nggnaargcnytngartggytngcnytnathtaytggaaygaygayaarmgntaywsnccnwsn
ytnaarwsnmgnytncanathcanaargaycanwsnaaraaycargtngtnytncanatgcana
ayatggayccngtngaycangcncantaytaytgygcncaymgnytngarytnccnttygayta
ytggggncarggncanytngtncangtnwsnwsn

U-V<sub>H</sub>-12 heavy chain variable region nucleotide sequence (SEQ ID NO:682)
carathcanytnaargarwsnggnccncanytngtnaarccncancarcanytncanytncant
gycanttywsnggnttywsnytnwsncanggnggngtnggngtnggntggathmgncarccnc
nggnaargcnytngartggytngcnytnathtaytggaaygaygayaarmgntaywsnccnwsn
ytnaarwsnmgnytncanathcanaargaycanwsnaaraaycargtngtnytncanatgcana
ayytngayccngtngaycangcncantaytaytgygcncaymgnmgngargtnccnttygayta
ytggggncarggncanytngtncangtnwsnwsn

U-V<sub>H</sub>-13 heavy chain variable region nucleotide sequence (SEQ ID NO:683)
carathcanytnaargarwsnggnccncanytngtnaarccncancarcanytncanytncant
gycanttywsnggnttywsnytnwsncanggnggngtnggngtnggntggathmgncarccnc
nggnaargcnytngartggytngcnytnathtaytggaaygtngaraarmgntaywsnccnwsn
ytnmgnwsnmgnytncanathcanaargcncanwsnaaraaycargtngtnytncanatgcana
ayatggayccngtngaycangcncantaytaytgygcncaymgncaycanaayccnttygarta
ytggggncarggncanytngtncangtnwsnwsn

U-V<sub>H</sub>-14 heavy chain variable region nucleotide sequence (SEQ ID NO:684)
carathcanytnaargarwsnggnccncanytngtnaarccncancarcanytncanytncant
gycanttywsnggnttywsnytnwsncanggnggngtnggngtnggntggathmgncarccnc
nggnaargcnytngartggytngcnytnathtaytggaaygaygayaarmgntaywsnccnwsn
ytnaarwsnmgnytncanathcanaargaycanwsnaaraaycargtngtnytncanatgcana
ayatggayccngtngaycangcncantaytaytgygcncaymgnggngarytnccnttygayta
ytggggncarggncanytngtncangtnwsnwsn

U-V<sub>H</sub>-15 heavy chain variable region nucleotide sequence (SEQ ID NO:684)
carathcanytnaargarwsnggnccncanytngtnaarccncancarcanytncanytncant
gycanttywsnggnttywsnytnwsncanggnggngtnggngtnggntggathmgncarccnc
nggnaargcnytngartggytngcnytnathtaytggaaygaygayaarmgntaywsnccnwsn
ytnaarwsnmgnytncanathcanaargaycanwsnaaraaycargtngtnytncanatgcana
ayatggayccngtngaycangcncantaytaytgygcncaymgnggngarytnccnttygayta
ytggggncarggncanytngtncangtnwsnwsn

FIGURE 16C

U-V<sub>H</sub>-16 heavy chain variable region nucleotide sequence (SEQ ID NO:685)
gargtncarytngtngarwsnggnggnggnytngtnaarccnggnggnwsnytnmgnytnwsnt
gygcngcnwsnggnttyccnttywsnmgntaywsnatgaaytgggtnmgncargcnccnggnaa
rggnytngartgggtnwsngcnathwsnwsnwsnwsnwsntayathtaytaygcngaywsngtn
aarggnmgnttycanathwsnmgngayaaygcnaaraaywsnytntayytncaratgaaywsny
tnmgngcngargaycangcngtntaytaytgygcnmgngaymgngtnggngcncaccngaygc
nttygayathtggggncarggncanatggtncangtnwsnwsn

U-V<sub>H</sub>-17 heavy chain variable region nucleotide sequence (SEQ ID NO:686)
gargtncarytnytngarwsnggnggnggnytngtncarccnggnggnwsnytnmgnytnwsnt
gygcngcnwsnggnttycanttywsnwsntaygcnatgaaytgggtnmgncargcnccnggnaa
rggnytngartgggtnwsngcnathwsnggnwsnggnggnwsncantaytaygcngaywsngtn
aarggnmgnttycanathwsnmgngayaaywsnaaraaycanytntayytncaratgaaywsny
tnmgngcngargaycangcngtntaytaytgygcnaargarggnathgcngtngcnggncangc
ngartaytaytaytaygcnatggaygtntggggncarggncancangtncangtnwsnwsn

U-V<sub>H</sub>-18 heavy chain variable region nucleotide sequence (SEQ ID NO:687)
gargtncarytnytngarwsnggnggnggnytngtncarccnggnggnwsnytnmgnytnwsnt
gygcngcnwsnggnttycanttywsnwsntaygcnatgwsntgggtnmgncargcnccnggnaa
rggnytngartgggtnwsngcnathwsnggnwsnggnggnwsncantaytaygcngaywsngtn
aarggnmgnttycanathwsnmgngayaaywsnaaraaycanytntayytncaratgaaywsny
tnmgngcngargaycangcngtntaytaytgygcnaargarggnathgcngcnmgngaywsnta
ytaytaytaygcnatggaygtntggggncarggncancangtncangtnwsnwsn

U-V<sub>H</sub>-19 heavy chain variable region nucleotide sequence (SEQ ID NO:688)
gargtncarytnytngarwsnggnggnggnytngtncarccnggnggnwsnytnmgnytnwsnt
gycangcnwsnggnttycanttywsnwsntaygcnatgwsntgggtnmgncargcnccnggnaa
rggnytngartgggtnwsngcnathwsnggnwsnggnggnwsncantaytaygcngaywsngtn
aarggnmgnttycanathwsnmgngayaaywsnaaraaycanytntayytncaratgaaywsny
tnmgngcngargaycangcngartaytaytgygcnaargarggnathgcnggnmgngaywsnta
ytaytayggnatggaygtntggggncarggncancangtncangtnwsnwsn

U-V<sub>H</sub>-20 heavy chain variable region nucleotide sequence (SEQ ID NO:688)
gargtncarytnytngarwsnggnggnggnytngtncarccnggnggnwsnytnmgnytnwsnt
gycangcnwsnggnttycanttywsnwsntaygcnatgwsntgggtnmgncargcnccnggnaa
rggnytngartgggtnwsngcnathwsnggnwsnggnggnwsncantaytaygcngaywsngtn
aarggnmgnttycanathwsnmgngayaaywsnaaraaycanytntayytncaratgaaywsny
tnmgngcngargaycangcngartaytaytgygcnaargarggnathgcnggnmgngaywsnta
ytaytayggnatggaygtntggggncarggncancangtncangtnwsnwsn

FIGURE 16D

U-V<sub>H</sub>-21 heavy chain variable region nucleotide sequence (SEQ ID NO:689)
cargtncarytngtngarwsnggnggnggngtngtncarccnggnmgnwsnytnmgnytnwsnt
gygcngcnwsnggnttycanttywsnwsntayggnatgcaytgggtnmgncargcnccnggnaa
rggnytngartgggtngcnttyathwsngaygayggnwsncanaartaytaygcngaywsngtn
aarggnmgnttycanathwsnmgngayaaywsnatgaaycanytntayytncaratgaaywsny
tnmgngcngargaycangcngtntaytaytgygcnmgnwsntaytaygaywsnwsnggntayta
ytayggnttygaytaytggggncarggncanytngtncangtnwsnwsn

U-V<sub>H</sub>-22 heavy chain variable region nucleotide sequence (SEQ ID NO:689)
cargtncarytngtngarwsnggnggnggngtngtncarccnggnmgnwsnytnmgnytnwsnt
gygcngcnwsnggnttycanttywsnwsntayggnatgcaytgggtnmgncargcnccnggnaa
rggnytngartgggtngcnttyathwsngaygayggnwsncanaartaytaygcngaywsngtn
aarggnmgnttycanathwsnmgngayaaywsnatgaaycanytntayytncaratgaaywsny
tnmgngcngargaycangcngtntaytaytgygcnmgnwsntaytaygaywsnwsnggntayta
ytayggnttygaytaytggggncarggncanytngtncangtnwsnwsn

U-V<sub>H</sub>-23 heavy chain variable region nucleotide sequence (SEQ ID NO:690)
cargtncarytngtngarwsnggnggnggngtngtncarccnggnmgnwsnytnmgnytnwsnt
gygcngcnwsnggnttycanttywsnwsntayggnatgcaytgggtnmgncargcnccnggnaa
rggnytngartgggtngcngtnathtggtaygayggnwsnaayaartaytaygcngaywsngtn
aarggnmgnttycanathwsnmgngayaaywsnaaraaycanytntayytncaratgaaywsny
tnmgngcngargaycangcngtntaytaytgygcnmgnaaygtnathgaytaytggggncargg
ncanytngtncangtnwsnwsn

U-V<sub>H</sub>-24 heavy chain variable region nucleotide sequence (SEQ ID NO:691)
cargtncarytngtngarwsnggnggnggngtngtncarccnggnmgnwsnytnmgnytnwsnt
gygcngcnwsnggnttycanttywsnwsntaygayatgcaytgggtnmgncargcnccnggnaa
rggnytngartgggtngcngtnathtggtaygayggnwsnathaartaytaygcngaywsngtn
aarggnmgnttycanathwsnmgngayaaywsnaaraaycanytntayytncaratgaaywsny
tnmgngcngargaycangcngtntaytaytgygcnmgnggnggngcncanggngcngartaytt
ycarcaytggggncarggncanytngtncangtnwsnwsn

U-V<sub>H</sub>-25 heavy chain variable region nucleotide sequence (SEQ ID NO:691)
cargtncarytngtngarwsnggnggnggngtngtncarccnggnmgnwsnytnmgnytnwsnt
gygcngcnwsnggnttycanttywsnwsntaygayatgcaytgggtnmgncargcnccnggnaa
rggnytngartgggtngcngtnathtggtaygayggnwsnathaartaytaygcngaywsngtn
aarggnmgnttycanathwsnmgngayaaywsnaaraaycanytntayytncaratgaaywsny
tnmgngcngargaycangcngtntaytaytgygcnmgnggnggngcncanggngcngartaytt
ycarcaytggggncarggncanytngtncangtnwsnwsn

FIGURE 16E

U-V<sub>H</sub>-26 heavy chain variable region nucleotide sequence (SEQ ID NO:692)
Cargtncarytngtngarwsnggnggnggngtngtncarccnggnmgnwsnytnmgnytnwsnt
gygcngcnwsnggnttycanttywsnwsntayggnatgcaytgggtnmgncargcnccnggnaa
rggnytngartgggtngcngtnathtggtaygayggnwsnaayaartaytaygcngaywsngtn
aarggnmgnttycanathwsnmgngayaaywsnaaraaycanytntayytncaratgaaywsny
tnmgngcngargaycangcngtntaytaytgygtnytntggttyggngarcanttygayta
ytggggncarggnwsnytngtncangtnwsnccn

U-V<sub>H</sub>-27 heavy chain variable region nucleotide sequence (SEQ ID NO:693)
cargtncarytngtngarwsnggnggnggngtngtncarccnggnmgnwsnytnmgnytnwsnt
gygcngcnwsnggnttycanttywsnwsntayggnatgcaytgggtnmgncargcnccnggnaa
rggnytngartgggtngcngtnathtggwsngayggnwsnaayaartaytaygcngaywsngtn
aarggnmgnttycanathwsnmgngayaaywsnaaraaycanytntayytncaratgaaywsny
tnmgngcngargaycangcngtntaytaytgygcnmgnaayytnccnttygaytaytggggnca
rggncanytngtncangtnwsnwsn

U-V<sub>H</sub>-28 heavy chain variable region nucleotide sequence (SEQ ID NO:694)
cargtncarytngtngarwsnggnggnggngtngtncarccnggnmgnwsnytnmgnytnwsnt
gygcngcnwsnggnttycanttywsnwsntayggnatgcaytgggtnmgncargcnccnggnaa
rggnytngartgggtngcngtnathtggaygayggnwsnaaycartaytaycangaywsngtn
aarggnmgnttycangtnwsnmgngayaaywsnaaraaycanytnttyytncaratgaaywsny
tnmgngcngargaycangcngtntaytaytgygcnmgnwsncaytayggnggngaytaygayta
ytayggnatggaygtntggggncarggncancangtncangtnwsnwsn

U-V<sub>H</sub>-29 heavy chain variable region nucleotide sequence (SEQ ID NO:695)
cargtncarytngtngarwsnggnggnggngtngtncarccnggnmgnwsnytnmgnytnwsnt
gygcngcnwsnggnttycanttywsnwsntayggnatgcaytgggtnmgncargcnccnggnaa
rggnytngartgggtngcngtnathtggtaygayggnwsnaayaarmgntaygtngaywsngtn
aarggnmgnttycanathwsnmgngayaaywsnaaraaycanytntayytncaratgaaywsny
tnmgngcngargaycangcngtntaytaytgygcnmgnayggntggcarcarcargcnccntt
ygaytaytggggncarggncanytngtncangtnwsnwsn

U-V<sub>H</sub>-30 heavy chain variable region nucleotide sequence (SEQ ID NO:696)
cargtncarytngtngarwsnggnggnggngtngtncarccnggnmgnwsnytnmgnytnwsnt
gygcngcnwsnggnttycanttymgnwsncayggnatgcaytgggtnmgncargcnccnggnaa
rggnytngartgggtngcngtnathtggtaygayggnwsnaayaaraaytaygcngaywsngtn
mgnggnmgnttycanathwsnmgngayaaywsnaaraaycanytngayytncaratgaaywsny
tnmgngcngargaycangcngtntaytaytgygcnmgntggggnathwsngcnccnttygaytg
ytggggncarggncanytngtncangtnwsnwsn

FIGURE 16F

U-V<sub>H</sub>-31 heavy chain variable region nucleotide sequence (SEQ ID NO:697)
gargtncarytngtngarwsnggnggnggnytngtncarccnggnggnwsnytnmgnytnwsnt
gygcngcnwsnggnttycanttywsngcntaywsnatgaaytgggtnmgncargcnccnggnaa
rggnytngartgggtnwsntayathwsnwsnwsnggnmgncanathtaytaygcngaywsngtn
aarggnmgnttycanathwsnmgngayaaygcnaaraaywsnytnttyytncaratgaaywsny
tnmgngaygargaycangcngtntaytaytgygcnytntgggcnccnttygaytaytggggnca
rggncanytngtncangtnwsnwsn U-V<sub>H</sub>-32 heavy chain variable region nucleotide sequence (SEQ ID NO:698)
gargtncarytngtngarwsnggnggnggnytngtncarccnggnggnwsnytnmgnytnwsnt
gygcngcnwsnggnttycanttywsnwsntaywsnatgaaytgggtnmgncargcnccnggnaa
rggnytngartgggtnwsncayathwsnwsnwsnwsnmgncanathtaytaygcngaywsngtn
aarggnmgnttycanathwsnmgngayaaygcnaaraaywsngtntayytncaratgaaywsny
tnmgngaygargaycangcngtntaytaytgygcnmgngayggntayaaytggaayggnggngg
naaytaytayggnatggaygtntggggncarggncancangtncangtnwsnwsn U-V<sub>H</sub>-33 heavy chain variable region nucleotide sequence (SEQ ID NO:699)
gargtncarytngtngarwsnggnggnggnytngtncarccnggnggnwsnytnmgnytnwsnt
gygcngcnwsnggnttycanttywsnwsntaywsnatgaaytgggtnmgncargcnccnggnaa
rggnytngartgggtnwsncayathwsnmgnwsnwsnmgncanathtaytaygcngaywsngtn
aarggnmgnttycanathwsnmgngayaaygcnaaraaywsnytntayytncaratgaaywsny
tnmgngaygargaycangcngtntaytaytgygcnmgngayggntayaaytggaayaayggngg
ntaytaytayggnatggaygtntggggncarggncancangtncangtnwsnwsn U-V<sub>H</sub>-34 heavy chain variable region nucleotide sequence (SEQ ID NO:699)
gargtncarytngtngarwsnggnggnggnytngtncarccnggnggnwsnytnmgnytnwsnt
gygcngcnwsnggnttycanttywsnwsntaywsnatgaaytgggtnmgncargcnccnggnaa
rggnytngartgggtnwsncayathwsnmgnwsnwsnmgncanathtaytaygcngaywsngtn
aarggnmgnttycanathwsnmgngayaaygcnaaraaywsnytntayytncaratgaaywsny
tnmgngaygargaycangcngtntaytaytgygcnmgngayggntayaaytggaayaayggngg
ntaytaytayggnatggaygtntggggncarggncancangtncangtnwsnwsn U-V<sub>H</sub>-35 heavy chain variable region nucleotide sequence (SEQ ID NO:700)
cargtncarytncargarwsnggnccnggnytngtnaarccnwsncarcanytnwsnytncant
gycangtnwsnggnggnwsngtnwsnwsnggnggntaytaytggwsntggathmgncarcaycc
nggnaarggnytngartggathggntayathcaywsnwsnggnwsncantaytayaayccnwsn
ytnaarwsnmgngtncanathwsngtngaycanwsnaaraaycarttywsnytnaayytnwsnw
sngtncangcngcngaycangcngtntaytaytgygcnmgnggnccntaytayggnatggaygt
ntggggncarggncancangtncangtnwsnwsn

FIGURE 16G

U-V_H-36 heavy chain variable region nucleotide sequence (SEQ ID NO:701)
cargtncarytncargarwsnggnccnggnytngtnaarccnwsncarcanytnwsnytncant
gycangtnwsnggnggnwsnathwsnmgnggnggntaytaytggwsntggathmgncarcaycc
nggnaarggnytngartggathggntayathtaycaywsnggnwsncantaytayaayccnwsn
ytnaarwsnmgngtnaayatgwsngtngaycanwsnaaraaycarttywsnytnaarytnwsnw
sngtncangcngcngaycangcngtntaytaytgygcnmgngcnytnmgnggnathgtnytnat
ggtntaygtnytnggngcnytngayathtggggncarggncanaargtncangtnwsnwsn

U-V_H-37 heavy chain variable region nucleotide sequence (SEQ ID NO:701)
cargtncarytncargarwsnggnccnggnytngtnaarccnwsncarcanytnwsnytncant
gycangtnwsnggnggnwsnathwsnmgnggnggntaytaytggwsntggathmgncarcaycc
nggnaarggnytngartggathggntayathtaycaywsnggnwsncantaytayaayccnwsn
ytnaarwsnmgngtnaayatgwsngtngaycanwsnaaraaycarttywsnytnaarytnwsnw
sngtncangcngcngaycangcngtntaytaytgygcnmgngcnytnmgnggnathgtnytnat
ggtntaygtnytnggngcnytngayathtggggncarggncanaargtncangtnwsnwsn

U-V_H-38 heavy chain variable region nucleotide sequence (SEQ ID NO:702)
cargtncarytncargarwsnggnccnggnytngtnaarccnwsncarcanytnwsnytncant
gycangtnwsnggnggnwsnathwsnwsnggnggntaytaytggwsntggathmgncarcaycc
nggnaarggnytngartggathggntayathtaytaywsnggnwsncantaytayaayccnwsn
ytnaarwsnmgngtncanathwsngtngaycanwsnaaraaycarttywsnytnaarytnwsnw
sngtncangcngcngaycangcngtntaytaytgygcnmgngaygarcangtngtnmgnggnyt
nathmgntaytgytayggnatggaygtntggggncarggncancangtncangtnwsnwsn

U-V_H-39 heavy chain variable region nucleotide sequence (SEQ ID NO:703)
cargtncarytncargarwsnggnccnggnytngtnaarccnwsncarcanytnwsnytnaayt
gycangtnwsnggnggnwsnathwsnwsnggnggntaytaytggwsntggathmgncarcaycc
nggnaarggnytngartggathggntayathcaytaywsnggnwsncantaytayaayccnwsn
ytnaarwsnmgnathcanathwsngcngaycanwsnaaraaycarttywsnytnaarytnaayw
sngtncangcngcngaycangcngtntaytaytgygcnmgngaymgnggnggnggngaytaygg
nmgnatggaygtntggggncarggncancangtncangtnwsnwsn

U-V_H-40 heavy chain variable region nucleotide sequence (SEQ ID NO:704)
cargtncarytncargarwsnggnccnggnytngtnaarccnwsncarcanytnwsnytnaayt
gycangtnwsnggnggnwsnathwsnwsnggnggntaytaytggwsntggathmgncarcaycc
nggnaarggnytngartggathggntayathcaytaywsnggnwsncantaytayaayccnwsn
ytnaarwsnmgnathcanathwsngcngaycanwsnaaraaycarttywsnytnaarytnaayw
sngtncangcngcngaycangcngtntaytaytgygcnmgngaymgnggnggnggngaytaygg
nmgnatggaygtntggggncarggncancangtncangtnwsnwsn

FIGURE 16H

U-V<sub>H</sub>-41 heavy chain variable region nucleotide sequence (SEQ ID NO:705)
cargtncarytncargarwsnggnccnggnytngtnaarccnwsncarcanytnwsnytncant
gycangtnwsnggnggnwsnathwsnwsnggnggntaytaytggwsntggathmgncarcaycc
nggnaarggnytngartggathggntayathcaywsnwsnggnwsncantaytayaayccnwsn
ytnaarwsnmgnathcanaarwsngtngaycanwsnaaraaycarttywsnytnaarytnwsnw
sngtncangcngcngaycangcngtntaytaytgygcnmgnwsnaayaaytayggntgyttygc
nytntggggnmgnggncanytngtncangtnwsnwsn U-V<sub>H</sub>-42 heavy chain variable region nucleotide sequence (SEQ ID NO:706)
cargtncarytncargarwsnggnccnggnytngtnaarccnwsncarcanytnwsnytncant
gycangtnwsnggnggnwsnathwsnwsnggnggntaytaytggwsntggathmgncarcaycc
nggnaarggnytngartggathggntayathcaywsnwsnggnwsncantaytayaayccnwsn
ytnaarwsnmgnathcanaarwsngtngaycanwsnaaraaycarttywsnytnaarytnwsnw
sngtncangcngcngaycangcngtntaytaytgygcnmgnwsnaayaaytayggntgyttygc
nytntggggnmgnggncanytngtncangtnwsnwsn U-V<sub>H</sub>-43 heavy chain variable region nucleotide sequence (SEQ ID NO:707)
cargtncarytncargarwsnggnccnggnytngtnaarccnwsncarcanytnwsnytncant
gycangtnwsnggnggnwsnathwsnwsnggnggntaytaytggwsntggathmgncarcaycc
nggnaarggnytngartggathggntayathcaytaywsnggnwsncantaytayaayccnwsn
ytnaarwsnmgngtncanathwsngtngaycanwsnaaraaycarttywsnytnaarytnwsnw
sngtncangcngcngaycangcngtntaytaytgygcnwsnggntayaaytayggnytntayta
ytaygaywsnwsnggntayccnwsntaytaytayggnatggaygtntggggncarggncancan
gtncangtnwsnwsn U-V<sub>H</sub>-44 heavy chain variable region nucleotide sequence (SEQ ID NO:708)
cargtncarytncargarwsnggnccnggnytngtnaarccnwsncarcanytnwsnytncant
gycangtnwsnggnggnwsnathwsnwsnggngaytaytaytggaaytgggtnmgncarcaycc
nggnaarggnytngartggathggntayathtaytaywsnggnggncantaytayaayccnwsn
ytnaarwsnmgngtncanathwsngtngaycanwsnaaraaycarttywsnytnaarytnttyw
sngtncangcngcngaycangcngtntayttytgygcnmgncantaytaygayathytncangg
ntayccnttytayttygaytaytggggncarggncanytngtncangtnwsnwsn U-V<sub>H</sub>-45 heavy chain variable region nucleotide sequence (SEQ ID NO:709)
cargtncarytncargarwsnggnccnggnytngtnaarccnwsncarcanytnwsnytncant
gycangtnwsnggnggnwsnathwsnwsnggngaytaytaytggaaytgggtnmgncarcaycc
nggnaarggnytngartggathggntayathtaytaywsnggnggncantaytayaayccnwsn
ytnaarwsnmgngtncanathwsngtngaycanwsnaaraaycarttywsnytnaarytnttyw
sngtncangcngcngaycangcngtntayttytgygcnmgncantaytaygayathytncangg
ntayccnttytayttygaytaytggggncarggncanytngtncangtnwsnwsn

FIGURE 16I

U-V_H-46 heavy chain variable region nucleotide sequence (SEQ ID NO:710)
cargtncarytncarcartggggngcnggnytnytnaarccnwsngarcanytnwsnytncant
gygcngtntayggnggnwsnttywsnggntaytaytggwsntggathmgncarccnccnggnaa
rggnytngartggathggngarathaaycaywsnggnwsncanaaytayaaycсnwsnytnaar
wsnmgngtncanathwsngtngaycanwsnaaraaycarttywsnytnaarytnwsnwsngtnc
angcngcngaycangcngtntaytaytgygcnmgnggnggntaywsnwsnwsntggtaytggtt
ygayccntggggncarggncanytngtncangtnwsnwsn U-V_H-47 heavy chain variable region nucleotide sequence (SEQ ID NO:711)
cargtncarytncarcartggggngcnggnytnytnaarccnwsngarcanytnwsnytncant
gygcngtntayggnggnwsnttywsnggntaytaytggwsntggathmgncarccnccnggnaa
rggnytngartggathggngarathaaycaywsnggnwsncanaaytayaaycсnwsnytnaar
wsnmgngtncanathwsngtngaycanwsnaaraaycarttywsnytnaarytnwsnwsngtnc
angcngcngaycangcngtntaytaytgygcnmgnggnggntaywsnwsnwsntggttytggtt
ygayccntggggncarggncanytngtncangtnwsnwsn U-V_H-48 heavy chain variable region nucleotide sequence (SEQ ID NO:711)
cargtncarytncarcartggggngcnggnytnytnaarccnwsngarcanytnwsnytncant
gygcngtntayggnggnwsnttywsnggntaytaytggwsntggathmgncarccnccnggnaa
rggnytngartggathggngarathaaycaywsnggnwsncanaaytayaaycсnwsnytnaar
wsnmgngtncanathwsngtngaycanwsnaaraaycarttywsnytnaarytnwsnwsngtnc
angcngcngaycangcngtntaytaytgygcnmgnggnggntaywsnwsnwsntggttytggtt
ygayccntggggncarggncanytngtncangtnwsnwsn U-V_H-49 heavy chain variable region nucleotide sequence (SEQ ID NO:711)
cargtncarytncarcartggggngcnggnytnytnaarccnwsngarcanytnwsnytncant
gygcngtntayggnggnwsnttywsnggntaytaytggwsntggathmgncarccnccnggnaa
rggnytngartggathggngarathaaycaywsnggnwsncanaaytayaaycсnwsnytnaar
wsnmgngtncanathwsngtngaycanwsnaaraaycarttywsnytnaarytnwsnwsngtnc
angcngcngaycangcngtntaytaytgygcnmgnggnggntaywsnwsnwsntggttytggtt
ygayccntggggncarggncanytngtncangtnwsnwsn U-V_H-50 heavy chain variable region nucleotide sequence (SEQ ID NO:711)
cargtncarytncarcartggggngcnggnytnytnaarccnwsngarcanytnwsnytncant
gygcngtntayggnggnwsnttywsnggntaytaytggwsntggathmgncarccnccnggnaa
rggnytngartggathggngarathaaycaywsnggnwsncanaaytayaaycсnwsnytnaar
wsnmgngtncanathwsngtngaycanwsnaaraaycarttywsnytnaarytnwsnwsngtnc
angcngcngaycangcngtntaytaytgygcnmgnggnggntaywsnwsnwsntggttytggtt
ygayccntggggncarggncanytngtncangtnwsnwsn

FIGURE 16J

U-V_H-51 heavy chain variable region nucleotide sequence (SEQ ID NO:712)
cargtncarytncargarwsnggnccnggnytngtnaarccnwsngarcanytnwsnytncant
gycangtnwsnggnggnwsnathwsnwsntaytaytggwsntggathmgncarccngcnggnaa
rggnytngartggathggnmgnathtaycanwsnggncancanaaytayaaycnwsnytnaar
wsnmgngtncanatgwsngtngaycanwsnaaraaycarttywsnytnaarytnwsnwsngtnc
angcngcngaycangcngtntaytaytgygcnmgngayggntaywsntayggncaytaytayta
ytayggnatggaygtntggggncarggncancangtncangtnwsnwsn

U-V_H-52 heavy chain variable region nucleotide sequence (SEQ ID NO:713)
cargtncarytncargarwsnggnccnggnytngtnaarccnwsngarcanytnwsnytncant
gycangtnwsnggnggnwsngtnwsnwsnggnggnwsntaytggwsntggathmgncarccncc
nggnaarggnytngartggathggntayathtaytaywsnggnwsncanaaytayaaycnwsn
ytnaarwsnmgngtncanathwsnathgtncanwsnmgnaaycarttywsnytnaarytnwsnw
sngtncangcngcngaycangcngtntaytaytgygcnmgnwsngcnytnmgntayttygaytg
gytnttywsngaygtnwsngayathtggggncarggncanatggtncangtnwsnwsn

U-V_H-53 heavy chain variable region nucleotide sequence (SEQ ID NO:713)
cargtncarytncargarwsnggnccnggnytngtnaarccnwsngarcanytnwsnytncant
gycangtnwsnggnggnwsngtnwsnwsnggnggnwsntaytggwsntggathmgncarccncc
nggnaarggnytngartggathggntayathtaytaywsnggnwsncanaaytayaaycnwsn
ytnaarwsnmgngtncanathwsnathgtncanwsnmgnaaycarttywsnytnaarytnwsnw
sngtncangcngcngaycangcngtntaytaytgygcnmgnwsngcnytnmgntayttygaytg
gytnttywsngaygtnwsngayathtggggncarggncanatggtncangtnwsnwsn

U-V_H-54 heavy chain variable region nucleotide sequence (SEQ ID NO:714)
gargtncarytngtncarwsnggngcngarytnaaraarccnggngarwsnytnaarathwsnt
gyaarggnwsnggntaymgnttycanwsntaytggathggntggtnmgncaratgccnggnaa
rggnytngartggatgggnathathtayccngaygaywsngaycanmgntaywsnccnwsntty
carggncargtncanathwsngcngayaarwsnathwsncangcntayytncartggwsnwsny
tnaargcnwsngaycangcnatgtaytaytgygcnmgncaraarwsntayggntaywsntaytt
ygaytaytggggncarggncanytngtncangtnwsnwsn

U-V_H-55 heavy chain variable region nucleotide sequence (SEQ ID NO:715)
gargtncarytngtncarwsnggngcngargtnaaraarccnggngarwsnytnaarathwsnt
gyaarggnwsnggntaywsnttycanwsntaytggathggntggtnmgncaratgccnggnaa
rggnytngartggatgggnathathtayccngaygaywsngaygcnmgntaywsnccnwsntty
carggncargtncanathwsngcngayaarwsnathaaycangcntayytncartggwsnwsny
tnaargcnwsngaycangcnatgtaytaytgygcnmgncarggntayggnwsnggntggggnta
yttygaytaytggggncarggncanytngtncangtnwsnwsn

FIGURE 16K

U-V$_H$-56 heavy chain variable region nucleotide sequence (SEQ ID NO:716)
gargtncarytngtncarwsnggngcngargtnaaraarccnggngarwsnytnaarathwsnt
gyaarggnwsnggntaywsnttycanwsntaytggathggntgggtnmgncaratgccnggnaa
rggnytngartggatgggnathathtayccnggngaywsngayathmgntaywsnccnwsntty
carggncargtncanathwsncngayaarwsnathwsncangcntayytncartggwsnwsny
tnaargcnwsngaycangcnatgtaytaytgygcnmgncarggnytngcngtngcnggncanws
ntaytaytaytaytayggnatggaygtntggggncarggncancangtncangtnwsnwsn U-V$_H$-57 heavy chain variable region nucleotide sequence (SEQ ID NO:717)
cargtncarytncarcarwsnggnccnggnytngtnaarccnwsncarcanytnwsnytncant
gygcnathwsnggngaywsngtnwsnwsntaywsngcngcntggaaytggathmgncarwsncc
nwsnmgnggnytngartggytnggnmgncantaytgymgnwsnaartggtayaaygaytaygcn
gtnwsngtnaarwsnmgnathcanathaayccngaycanwsnaaraaycarttywsnytncary
tnaaywsngtncanccngargaycangcngtntaytaytgygcnmgngaymgngcngtngcngg
ntaytaytayggnatggaygtntggggncarggncancangtncangtnwsnwsn U-V$_H$-58 heavy chain variable region nucleotide sequence (SEQ ID NO:697)
gargtncarytngtngarwsnggngggnggnytngtncarccnggngggnwsnytnmgnytnwsnt
gygcngcnwsnggnttycanttywsngcntaywsnatgaaytgggtnmgncargcnccnggnaa
rggnytngartgggtnwsntayathwsnwsnwsnggnmgncanathtaytaygcngaywsngtn
aarggnmgnttycanathwsnmgngayaaygcnaaraaywsnytnttyytncaratgaaywsny
tnmgngaygargaycangcngtntaytaytgygcnytntgggcnccnttygaytaytggggnca
rggncanytngtncangtnwsnwsn

FIGURE 16L

LIGHT CHAIN CONSTANT REGION NUCLEOTIDE SEQUENCE

CGAACTGTGGCTGCACCATCTGTCTTCATCTTCCCGCCATCTGATGAGCAGTTGAAATCTGGAACTGCTAGCGTTGT
GTGCCTGCTGAATAACTTCTATCCCAGAGAGGCCAAAGTACAGTGGAAGGTGGATAACGCCCTCCAATCGGGTAACT
CCCAGGAGAGTGTCACAGAGCAGGACAGCAAGGACAGCACCTACAGCCTCAGCAGCACCCTGACGCTGAGCAAAGCA
GACTACGAGAAACACAAAGTCTACGCCTGCGAAGTCACCCATCAGGGCCTGAGCTCGCCCGTCACAAAGAGCTTCAA
CAGGGGAGAGTGTTAG (SEQ ID NO:718)

FIGURE 17A

HEAVY CHAIN CONSTANT REGION NUCLEOTIDE SEQUENCE

GCCTCCACCAAGGGCCCATCGGTCTTCCCCCTGGCGCCCTGCTCTAGAAGCACCTCCGAGAGCACAGCGGCCCTGGG
CTGCCTGGTCAAGGACTACTTCCCCGAACCGGTGACGGTGTCGTGGAACTCAGGCGCTCTGACCAGCGGCGTGCACA
CCTTCCCAGCTGTCCTACAGTCCTCAGGACTCTACTCCCTCAGCAGCGTGGTGACCGTGCCCTCCAGCAACTTCGGC
ACCCAGACCTACACATGCAACGTAGATCACAAGCCCAGCAACACCAAGGTGGACAAGACAGTTGAGCGCAAATGTTG
TGTCGAGTGCCCACCGTGCCCAGCACCACCTGTGGCAGGACCGTCAGTCTTCCTCTTCCCCCCAAAACCCAAGGACA
CCCTCATGATCTCCCGGACCCCTGAGGTCACGTGCGTGGTGGTGGACGTGAGCCACGAAGACCCCGAGGTCCAGTTC
AACTGGTACGTGGACGGCGTGGAGGTGCATAATGCCAAGACAAAGCCACGGGAGGAGCAGTTCAACAGCACGTTCCG
TGTGGTCAGCGTCCTCACCGTTGTGCACCAGGACTGGCTGAACGGCAAGGAGTACAAGTGCAAGGTCTCCAACAAAG
GCCTCCCAGCCCCCATCGAGAAAACCATCTCCAAAACCAAAGGGCAGCCCCGAGAACCACAGGTGTACACCCTGCCC
CCATCCCGGGAGGAGATGACCAAGAACCAGGTCAGCCTGACCTGCCTGGTCAAAGGCTTCTACCCCAGCGACATCGC
CGTGGAGTGGGAGAGCAATGGGCAGCCGGAGAACAACTACAAGACCACACCTCCCATGCTGGACTCCGACGGCTCCT
TCTTCCTCTACAGCAAGCTCACCGTGGACAAGAGCAGGTGGCAGCAGGGGAACGTCTTCTCATGCTCCGTGATGCAT
GAGGCTCTGCACAACCACTACACGCAGAAGAGCCTCTCCCTGTCTCCGGGTAAATGA (SEQ ID NO:719)

FIGURE 17B

LIGHT CHAIN CDR NUCLEOTIDE SEQUENCES

| NAME | SEQUENCE | SEQ ID NO |
|---|---|---|
| CDRL1-1 | mgnwsnwsncarwsnytngtntaywsngayggnaaycantayytnaay | 720 |
| CDRL1-2 | mgnwsnwsncarwsnytngtntaywsngayggnaaycantayytnaay | 720 |
| CDRL1-3 | mgnwsnwsncarwsnytngtntaywsngayggnaaycantayytnaay | 720 |
| CDRL1-4 | mgnwsnwsncarwsnytngtntaywsngayggnaaycantayytnaay | 720 |
| CDRL1-5 | aarwsnwsncarwsnytnytncaywsngayggnaarcantayytntay | 721 |
| CDRL1-6 | aarwsnwsncarwsnytnytncaywsngayggnaarcantayytntay | 721 |
| CDRL1-7 | aarwsnwsncarwsnytnytncaywsngayggnaarcantayytntay | 721 |
| CDRL1-8 | aarwsnwsncarwsnytnytncaywsngayggnaarcantayytntay | 721 |
| CDRL1-9 | aarwsnwsncarwsnytnytncaywsngayggnaarcantayytntay | 721 |
| CDRL1-11 | mgngcnwsncarggnathgcnaaytayytngcn | 722 |
| CDRL1-12 | mgngcnwsncarggnathwsnaaygayytngcn | 723 |
| CDRL1-13 | mgnwsnwsncarwsnytngtncaywsngayggnaaycantayytnwsn | 724 |
| CDRL1-14 | mgnwsnwsncarwsnytngtncaywsngayggnaaycantayytnwsn | 724 |
| CDRL1-15 | mgnwsnwsncarwsnytngtncaywsngayggnaaycantayytnwsn | 724 |
| CDRL1-16 | mgngcnwsncarcangtnathwsnwsntayytngcn | 725 |
| CDRL1-17 | mgngcnwsncarwsngtnwsnmgnytngcn | 726 |
| CDRL1-18 | mgngcnwsncarggnathmgnaaygayytnggn | 727 |
| CDRL1-19 | aarwsnwsncarwsngtnytntaywsnwsnaayaayaaraaytayytngtn | 728 |
| CDRL1-20 | aarwsnwsncarwsngtnytntaywsnwsnaayaayaaraaytayytngtn | 728 |
| CDRL1-21 | aarwsnwsncarwsngtnytntaywsnwsnaayaayaaraaytayytngcn | 729 |
| CDRL1-22 | aarwsnwsncaraaygtnytntaywsnwsnaayaayaaraaytayytngcn | 730 |
| CDRL1-23 | aarwsnwsncaraaygtnytntaywsnwsnaayaayaaraaytayytngcn | 730 |
| CDRL1-24 | aarwsnwsncarwsngtnytntaywsnwsnaayaayaaraaytayytngcn | 729 |
| CDRL1-25 | aarwsnwsncarwsngtnytntaywsnwsnaayaayaaraaytayytngcn | 729 |
| CDRL1-26 | aarwsnwsncarwsngtnytntayaaywsnaayaayaaraaytayytngcn | 731 |

FIGURE 18A

| NAME | SEQUENCE | SEQ ID NO |
|---|---|---|
| CDRL1-27 | aarwsnwsncarwsngtnytntayaaywsnaayaayaaraaytayytngcn | 731 |
| CDRL1-28 | aarwsnwsncarwsngtnytntaywsnwsnaayaayaaraaytayytngcn | 729 |
| CDRL1-29 | aarwsnwsncarwsngtnytntaywsnwsnaayaayaaraaytayytngcn | 729 |
| CDRL1-30 | aarwsnwsncarwsngtnytngaywsnwsnaayaayaaraaytayytngcn | 732 |
| CDRL1-31 | aarwsnwsncarwsngtnytngaywsnwsnaayaayaaraaytayytngcn | 732 |
| CDRL1-32 | aarwsnwsncarwsnathytntaymgnwsnaayaayaaraaytayytngcn | 733 |
| CDRL1-33 | aarwsnwsncarwsnathytntaymgnwsnaayaayaaraaytayytngcn | 733 |
| CDRL1-34 | mgngcnwsncargayathwsncaytayytngcn | 734 |
| CDRL1-35 | mgngcnwsncargayathwsnaaytayytngcn | 735 |
| CDRL1-36 | mgngcnwsncarwsngtnwsnwsnaayytngcn | 736 |
| CDRL1-37 | mgngcnwsncarwsngtnwsnwsnaayytngcn | 736 |
| CDRL1-38 | mgngcnwsncargayathwsnmgntggytngcn | 737 |
| CDRL1-39 | mgngcnwsncarwsnathwsncantayytnaay | 738 |
| CDRL1-40 | mgngcnwsncarcanathwsnathtayytnaay | 739 |
| CDRL1-41 | mgngcnwsncarwsnathmgnwsntayytnaay | 740 |
| CDRL1-42 | mgngcnwsncarcanathwsnmgntayytnaay | 741 |
| CDRL1-43 | mgngcnwsncarmgnathwsnwsntayytnaay | 742 |
| CDRL1-44 | mgngcnwsncarwsnathwsnmgntayytnaay | 743 |
| CDRL1-45 | mgngcnwsncarwsnathwsnwsntayytnaay | 744 |
| CDRL1-46 | mgngcnwsncarwsnathwsnwsntayytnaay | 744 |
| CDRL1-47 | mgngcnwsncarwsnathwsnwsntayytnaay | 744 |
| CDRL1-48 | mgngcnwsncarwsnathwsnwsntayytnaay | 744 |
| CDRL1-49 | mgngcnwsncarwsnathwsnwsntayytnaay | 744 |
| CDRL1-50 | mgngcnwsncarwsnathwsnwsntayytnaay | 744 |
| CDRL1-51 | mgngcnwsncarwsnathwsnwsntayytnaay | 744 |
| CDRL1-52 | mgngcnwsncarwsnathwsnwsntayytnaay | 744 |
| CDRL1-53 | mgngcnwsncarwsnathwsnwsntayytnaay | 744 |
| CDRL1-54 | cargcnwsncargayathwsnaaytayytnaay | 745 |
| CDRL1-55 | cargcnwsncargayathwsnaaytayytnaay | 745 |
| CDRL1-56 | cargcnwsncargayathwsnaaywsnytnaay | 746 |
| CDRL1-57 | cargcnwsncargayathwsngaytayytnaay | 747 |

FIGURE 18B

| NAME | SEQUENCE | SEQ ID NO |
|---|---|---|
| CDRL1-58 | cargcnwsncargayathwsnaaytayytnaay | 745 |
| CDRL1-59 | cargcnwsncargayathwsnaaytayytnaay | 745 |
| CDRL1-60 | cargcnwsncargayathwsnaaywsnytnaay | 746 |
| CDRL1-61 | cargcnwsncargayathwsnaaywsnytnaay | 746 |
| CDRL1-62 | cargcnwsncargayathcanaaytayytnaay | 748 |
| CDRL1-63 | cargcnwsncargayathwsnaaytayytnaay | 745 |
| CDRL1-64 | cargcnwsncargayathwsngaytayytnaay | 747 |
| CDRL1-65 | cargcnwsncargayathwsnaaywsnytnaay | 746 |
| CDRL2-1 | aargtnwsnaaytgggaywsn | 749 |
| CDRL2-2 | aargtnwsnaaytgggaywsn | 749 |
| CDRL2-3 | aargtnwsnaaytgggaywsn | 749 |
| CDRL2-4 | aargtnwsnaaytgggaywsn | 749 |
| CDRL2-5 | gargtnwsnaaymgnttywsn | 750 |
| CDRL2-6 | gargtnwsnaaymgnttywsn | 750 |
| CDRL2-7 | gargtnwsnaaymgnttywsn | 750 |
| CDRL2-8 | gargtnwsnaaymgnttywsn | 750 |
| CDRL2-9 | gargtnwsnaaymgnttywsn | 750 |
| CDRL2-11 | gtngcnwsncanytncarwsn | 751 |
| CDRL2-12 | gcngcnwsncanytncarwsn | 752 |
| CDRL2-13 | aarathwsnaaymgnttywsn | 753 |
| CDRL2-14 | aarathwsnaaymgnttywsn | 753 |
| CDRL2-15 | aarathwsnaaymgnttywsn | 753 |
| CDRL2-16 | ggngcnwsnwsnmgngcncan | 754 |
| CDRL2-17 | ggngcnwsnmgnmgngcncan | 755 |
| CDRL2-18 | gcngcnwsnwsnytncarwsn | 756 |
| CDRL2-19 | tgggcnwsncanmgngarwsn | 757 |
| CDRL2-20 | tgggcnwsncanmgngarwsn | 757 |
| CDRL2-21 | tgggcnwsncanmgngarwsn | 757 |
| CDRL2-22 | tgggcnwsncanmgngarwsn | 757 |
| CDRL2-23 | tgggcnwsncanmgngarwsn | 757 |
| CDRL2-24 | tgggcnwsncanmgngarwsn | 757 |
| CDRL2-25 | tgggcnwsncanmgngarwsn | 757 |
| CDRL2-26 | tgggcnwsncanmgngarwsn | 757 |
| CDRL2-27 | tgggcnwsncanmgngarwsn | 757 |
| CDRL2-28 | tgggcnwsncanmgnaarwsn | 758 |
| CDRL2-29 | tgggcnwsncanmgnaarwsn | 758 |

FIGURE 18C

| NAME | SEQUENCE | SEQ ID NO |
|---|---|---|
| CDRL2-30 | tgggcnwsncanmgngarwsn | 757 |
| CDRL2-31 | tgggcnwsncanmgngarwsn | 757 |
| CDRL2-32 | tgggcnwsngcnmgngarwsn | 759 |
| CDRL2-33 | tgggcnwsngcnmgngarwsn | 759 |
| CDRL2-34 | gcngcnwsnwsnytncarwsn | 756 |
| CDRL2-35 | gcngcnwsnwsnytncarwsn | 756 |
| CDRL2-36 | ggngcnwsnmgnmgngcncan | 755 |
| CDRL2-37 | ggngcnwsnmgnmgngcncan | 755 |
| CDRL2-38 | gcngcnwsnwsnytncarwsn | 756 |
| CDRL2-39 | gcngcnwsnwsnytncarwsn | 756 |
| CDRL2-40 | gcngcnwsnwsnytncarwsn | 756 |
| CDRL2-41 | gcngcnwsnwsnytncarwsn | 756 |
| CDRL2-42 | gcngcnwsncanytncarwsn | 752 |
| CDRL2-43 | gcngarwsnwsnytncarwsn | 760 |
| CDRL2-44 | cangcnwsnwsnytncarwsn | 761 |
| CDRL2-45 | cangcnwsnwsnytncarwsn | 761 |
| CDRL2-46 | cangcnwsnwsnytncarwsn | 761 |
| CDRL2-47 | cangcnwsnwsnytncarwsn | 761 |
| CDRL2-48 | cangtnwsnwsnytncarwsn | 762 |
| CDRL2-49 | cangtnwsnwsnytncarwsn | 762 |
| CDRL2-50 | cangtnwsnwsnytncarwsn | 762 |
| CDRL2-51 | cangcnwsnwsnytncarwsn | 761 |
| CDRL2-52 | cangcnwsnwsnytncarwsn | 761 |
| CDRL2-53 | cangcnwsnwsnytncarwsn | 761 |
| CDRL2-54 | gaygcnwsnaayytngarcan | 763 |
| CDRL2-55 | gaygcnwsnaayytngarcan | 763 |
| CDRL2-56 | gaygcnwsnaayytngarcan | 763 |
| CDRL2-57 | gaygcnwsnaayytngarcan | 763 |
| CDRL2-58 | gaygcnwsnaayytngarcan | 763 |
| CDRL2-59 | gaygcnwsnaayytngarcan | 763 |
| CDRL2-60 | gaygcnwsnathytngarcan | 764 |
| CDRL2-61 | gaygcnwsnaayytngarcan | 763 |
| CDRL2-62 | gaygcnwsnaayytngarcan | 763 |
| CDRL2-63 | gaygcnwsnaayytngarcan | 763 |
| CDRL2-64 | gaygcnwsnaayytngarcan | 763 |
| CDRL2-65 | gaygcnwsnaayytngarcan | 763 |

FIGURE 18D

| NAME | SEQUENCE | SEQ ID NO |
|---|---|---|
| CDRL3-1 | atgcarwsncancaytggccnathcan | 765 |
| CDRL3-2 | athcarggncancaytggccncancan | 766 |
| CDRL3-3 | atgcarggncancaytggccnathcan | 767 |
| CDRL3-4 | atgcarggncancaytggccnathcan | 767 |
| CDRL3-5 | atgcarggnathcarytnccntgywsn | 768 |
| CDRL3-6 | atgcarwsnathcarytnccnytncan | 769 |
| CDRL3-7 | atgcarwsnathcarytnccnytncan | 769 |
| CDRL3-8 | atgcarwsnathcarytnccnathcan | 770 |
| CDRL3-9 | atgcarwsnathcarytnccnathcan | 770 |
| CDRL3-11 | caraaytayaaywsngcnccnttycan | 771 |
| CDRL3-12 | caraartayaaywsngtnccnytncan | 772 |
| CDRL3-13 | atgcargcncancarttyccncaycan | 773 |
| CDRL3-14 | atgcargcncancarttyccncaycan | 773 |
| CDRL3-15 | atgcargcncancarttyccncaycan | 773 |
| CDRL3-16 | carcartayggnwsnwsnccnmgncan | 774 |
| CDRL3-17 | carcartayggnwsnwsnccnmgnwsn | 775 |
| CDRL3-18 | ytncarcayaaywsntayccnccncan | 776 |
| CDRL3-19 | carcartaytaywsnttyccntggcan | 777 |
| CDRL3-20 | carcartaytaywsnttyccntggcan | 777 |
| CDRL3-21 | carcartaytaywsncancantggcan | 778 |
| CDRL3-22 | carcartaytayggncanccnmgncan | 779 |
| CDRL3-23 | carcartaytayggncanccnmgncan | 779 |
| CDRL3-24 | carcartaytaywsnathwsnmgncan | 780 |
| CDRL3-25 | carcartaytaywsnathwsnmgncan | 780 |
| CDRL3-26 | carcartaytaywsncancantggcan | 778 |
| CDRL3-27 | carcartaytaywsncancantggcan | 778 |
| CDRL3-28 | carcartaytaywsncanatgttywsn | 781 |
| CDRL3-29 | carcartaytaywsncanatgttywsn | 781 |
| CDRL3-30 | caycartaytaywsncanccnytncan | 782 |
| CDRL3-31 | caycartaytaywsncanccnytncan | 782 |
| CDRL3-32 | carcartayttyathcanccnytncan | 783 |
| CDRL3-33 | carcartayttyathcanccnytncan | 783 |
| CDRL3-34 | carcartayaayaaytayccnttycan | 784 |
| CDRL3-35 | carcartayaaycantayccnttycan | 785 |
| CDRL3-36 | carcarcayaayaaytggccnccntggcan | 786 |
| CDRL3-37 | carcarcayaayaaytggccnccntggcan | 786 |

FIGURE 18E

| NAME | SEQUENCE | SEQ ID NO |
|---|---|---|
| CDRL3-38 | carcargcnaaywsnttyccnccncan | 787 |
| CDRL3-39 | carcarwsncaywsngcnccnttycan | 788 |
| CDRL3-40 | carcarwsntaywsncanytncan | 789 |
| CDRL3-41 | carcarwsntaywsnathccnytncan | 790 |
| CDRL3-42 | carcarathtaywsncanwsnathcan | 791 |
| CDRL3-43 | carcarwsntayathcanccnathcan | 792 |
| CDRL3-44 | carcarwsntayttycanccnathcan | 793 |
| CDRL3-45 | carcarwsntayttywsnccnathcan | 794 |
| CDRL3-46 | carcarwsnttytaycanccnathcan | 795 |
| CDRL3-47 | carcarwsnttytaycanccnathcan | 795 |
| CDRL3-48 | carcarwsntayttycanccnathcan | 793 |
| CDRL3-49 | carcarwsntayttycanccnathcan | 793 |
| CDRL3-50 | carcarwsntayttycanccnathcan | 793 |
| CDRL3-51 | carcarwsnttytaygcnccnathcan | 796 |
| CDRL3-52 | carcarwsnttytaygcnccnathcan | 796 |
| CDRL3-53 | carcarwsntayttycanccnathcan | 793 |
| CDRL3-54 | carcartaygaytayytnccnttycan | 797 |
| CDRL3-55 | carcartaygaytayytnccnttycan | 797 |
| CDRL3-56 | carcartgygaygayytnccnytncan | 798 |
| CDRL3-57 | carcaytaygayaayytnccnytncan | 799 |
| CDRL3-58 | carcartaygayaayytnccnytncan | 800 |
| CDRL3-59 | carcartaygayaayytnccnytncan | 800 |
| CDRL3-60 | carcartgygayathytnccnytnwsn | 801 |
| CDRL3-61 | carcartaygayaayytnccnytngcn | 802 |
| CDRL3-62 | carcartaygaywsnytnccnathcan | 803 |
| CDRL3-63 | carcartaygayaayytnccnathcan | 804 |
| CDRL3-64 | carcaytaygayaayytnccnathcan | 805 |
| CDRL3-65 | carcaytaygayaayytnccnathcan | 805 |

FIGURE 18F

HEAVY CHAIN CDR NUCLEOTIDE SEQUENCES

| NAME | SEQUENCE | SEQ ID NO: |
|---|---|---|
| CDRH1-1 | ggntaycanttycanwsntayggnathwsn | 792 |
| CDRH1-2 | ggntaycanttycanwsntayggnathwsn | 792 |
| CDRH1-3 | ggntaycanttycanggncaytayatgcay | 793 |
| CDRH1-4 | ggntaycanttycanggntaytayatgcay | 794 |
| CDRH1-5 | ggntaycanytncangarytnwsnatgcay | 795 |
| CDRH1-6 | ggntaycanytncangarytnwsnatgcay | 795 |
| CDRH1-7 | ggnttywsnytnwsnaaygcnmgnatgggngtnwsn | 796 |
| CDRH1-8 | ggnttywsnytnwsnaaygcnmgnatgggngtnwsn | 796 |
| CDRH1-9 | ggnttywsnytnwsncangggnggngtnggngtnggn | 797 |
| CDRH1-10 | ggnttywsnytnwsncangggnggngtnggngtnggn | 797 |
| CDRH1-11 | ggnttywsnytnaaycangggnggngtnggngtnggn | 798 |
| CDRH1-12 | ggnttywsnytnwsncangggnggngtnggngtnggn | 797 |
| CDRH1-13 | ggnttywsnytnwsncangggnggngtnggngtnggn | 797 |
| CDRH1-14 | ggnttywsnytnwsncangggnggngtnggngtnggn | 797 |
| CDRH1-15 | ggnttywsnytnwsncangggnggngtnggngtnggn | 797 |
| CDRH1-16 | ggnttyccnttywsnmgntaywsnatgaay | 799 |
| CDRH1-17 | ggnttycanttywsnwsntaygcnatgaay | 800 |
| CDRH1-18 | ggnttycanttywsnwsntaygcnatgwsn | 801 |
| CDRH1-19 | ggnttycanttywsnwsntaygcnatgwsn | 801 |
| CDRH1-20 | ggnttycanttywsnwsntaygcnatgwsn | 801 |
| CDRH1-21 | ggnttycanttywsnwsntayggnatgcay | 802 |
| CDRH1-22 | ggnttycanttywsnwsntayggnatgcay | 802 |
| CDRH1-23 | ggnttycanttywsnwsntayggnatgcay | 802 |
| CDRH1-24 | ggnttycanttywsnwsntaygayatgcay | 803 |
| CDRH1-25 | ggnttycanttywsnwsntaygayatgcay | 803 |
| CDRH1-26 | ggnttycanttywsnwsntayggnatgcay | 802 |
| CDRH1-27 | ggnttycanttywsnwsntayggnatgcay | 802 |
| CDRH1-28 | ggnttycanttywsnwsntayggnatgcay | 802 |
| CDRH1-29 | ggnttycanttywsnwsntayggnatgcay | 802 |
| CDRH1-30 | ggnttycanttymgnwsncayggnatgcay | 804 |
| CDRH1-31 | ggnttycanttywsngcntaywsnatgaay | 805 |
| CDRH1-32 | ggnttycanttywsnwsntaywsnatgaay | 806 |
| CDRH1-33 | ggnttycanttywsnwsntaywsnatgaay | 806 |
| CDRH1-34 | ggnttycanttywsnwsntaywsnatgaay | 806 |
| CDRH1-35 | ggnggnwsngtnwsnwsnggnggntaytaytggwsn | 807 |
| CDRH1-36 | ggnggnwsnathwsnmgnggnggntaytaytggwsn | 808 |
| CDRH1-37 | ggnggnwsnathwsnmgnggnggntaytaytggwsn | 808 |
| CDRH1-38 | ggnggnwsnathwsnwsnggnggntaytaytggwsn | 809 |

FIGURE 19A

| NAME | SEQUENCE | SEQ ID NO: |
|---|---|---|
| CDRH1-39 | ggnggnwsnathwsnwsnggnggntaytaytggwsn | 809 |
| CDRH1-40 | ggnggnwsnathwsnwsnggnggntaytaytggwsn | 809 |
| CDRH1-41 | ggnggnwsnathwsnwsnggnggntaytaytggwsn | 809 |
| CDRH1-42 | ggnggnwsnathwsnwsnggnggntaytaytggwsn | 809 |
| CDRH1-43 | ggnggnwsnathwsnwsnggnggntaytaytggwsn | 809 |
| CDRH1-44 | ggnggnwsnathwsnwsnggngaytaytaytggaay | 810 |
| CDRH1-45 | ggnggnwsnathwsnwsnggngaytaytaytggaay | 810 |
| CDRH1-46 | ggnggnwsnttywsnggntaytaytggwsn | 811 |
| CDRH1-47 | ggnggnwsnttywsnggntaytaytggwsn | 811 |
| CDRH1-48 | ggnggnwsnttywsnggntaytaytggwsn | 811 |
| CDRH1-49 | ggnggnwsnttywsnggntaytaytggwsn | 811 |
| CDRH1-50 | ggnggnwsnttywsnggntaytaytggwsn | 811 |
| CDRH1-51 | ggnggnwsnathwsnwsntaytaytggwsn | 812 |
| CDRH1-52 | ggnggnwsngtnwsnwsnggnggnwsntaytggwsn | 813 |
| CDRH1-53 | ggnggnwsngtnwsnwsnggnggnwsntaytggwsn | 813 |
| CDRH1-54 | ggntaymgnttycanwsntaytggathggn | 814 |
| CDRH1-55 | ggntaywsnttycanwsntaytggathggn | 815 |
| CDRH1-56 | ggntaywsnttycanwsntaytggathggn | 815 |
| CDRH1-57 | ggngaywsngtnwsnwsntaywsngcngcntggaay | 816 |
| CDRH1-58 | ggnttycanttywsngcntaywsnatgaay | 805 |
| CDRH2-1 | tggathwsngcnwsnaayggnaaycanaaytaygcncaraarytncargay | 817 |
| CDRH2-2 | tggathwsngcnwsnaayggnaaycanaaytaygcncaraarytncargay | 817 |
| CDRH2-3 | tggathaayccnaaywsnggnggncanaaytgygcncaraarttycarggn | 818 |
| CDRH2-4 | tggathaayccnaaywsnggnggncanaaycaycancaraarttycarggn | 819 |
| CDRH2-5 | wsnttygayccngargayggngarcanathtaygcncaraarttycarggn | 820 |
| CDRH2-6 | wsnttygayccngargayggngarcanathtaygcncaraarttycarggn | 820 |
| CDRH2-7 | cayathttywsnaaygaygaraarwsntaywsncanwsnytnaarwsn | 821 |
| CDRH2-8 | ytnathttywsnaaygaygaraarwsntaywsncanwsnytnaarwsn | 822 |
| CDRH2-9 | ytnathtaytggaaygaygayaarmgntaywsnccnwsnytnaarwsn | 823 |

FIGURE 19B

| NAME | SEQUENCE | SEQ ID NO: |
|---|---|---|
| CDRH2-10 | ytnathtaytggaaygaygayaarmgntaywsnccnwsnytnaarwsn | 823 |
| CDRH2-11 | ytnathtaytggaaygaygayaarmgntaywsnccnwsnytnaarwsn | 823 |
| CDRH2-12 | ytnathtaytggaaygaygayaarmgntaywsnccnwsnytnaarwsn | 823 |
| CDRH2-13 | ytnathtaytggaaygtngaraarmgntaywsnccnwsnytnmgnwsn | 824 |
| CDRH2-14 | ytnathtaytggaaygaygayaarmgntaywsnccnwsnytnaarwsn | 823 |
| CDRH2-15 | ytnathtaytggaaygaygayaarmgntaywsnccnwsnytnaarwsn | 823 |
| CDRH2-16 | gcnathwsnwsnwsnwsnwsntayathtaytaygcngaywsngtnaarggn | 825 |
| CDRH2-17 | gcnathwsnggnwsnggnggnwsncantaytaygcngaywsngtnaarggn | 826 |
| CDRH2-18 | gcnathwsnggnwsnggnggnwsncantaytaygcngaywsngtnaarggn | 826 |
| CDRH2-19 | gcnathwsnggnwsnggnggnwsncantaytaygcngaywsngtnaarggn | 826 |
| CDRH2-20 | gcnathwsnggnwsnggnggnwsncantaytaygcngaywsngtnaarggn | 826 |
| CDRH2-21 | ttyathwsngaygayggnwsncanaartaytaygcngaywsngtnaarggn | 827 |
| CDRH2-22 | ttyathwsngaygayggnwsncanaartaytaygcngaywsngtnaarggn | 827 |
| CDRH2-23 | gtnathtggtaygayggnwsnaayaartaytaygcngaywsngtnaarggn | 828 |
| CDRH2-24 | gtnathtggtaygayggnwsnathaartaytaygcngaywsngtnaarggn | 829 |
| CDRH2-25 | gtnathtggtaygayggnwsnathaartaytaygcngaywsngtnaarggn | 829 |
| CDRH2-26 | gtnathtggtaygayggnwsnaayaartaytaygcngaywsngtnaarggn | 828 |
| CDRH2-27 | gtnathtggwsngayggnwsnaayaartaytaygcngaywsngtnaarggn | 830 |
| CDRH2-28 | gtnathtgggaygayggnwsnaaycartaytaycangaywsngtnaarggn | 831 |

FIGURE 19C

| NAME | SEQUENCE | SEQ ID NO: |
|---|---|---|
| CDRH2-29 | gtnathtggtaygayggnwsnaayaarmgntaygtngaywsngtnaarggn | 832 |
| CDRH2-30 | gtnathtggtaygayggnwsnaayaaraaytaygcngaywsngtnmgnggn | 833 |
| CDRH2-31 | tayathwsnwsnwsnggnmgncanathtaytaygcngaywsngtnaarggn | 834 |
| CDRH2-32 | cayathwsnwsnwsnwsnmgncanathtaytaygcngaywsngtnaarggn | 835 |
| CDRH2-33 | cayathwsnmgnwsnwsnmgncanathtaytaygcngaywsngtnaarggn | 836 |
| CDRH2-34 | cayathwsnmgnwsnwsnmgncanathtaytaygcngaywsngtnaarggn | 836 |
| CDRH2-35 | tayathcaywsnwsnggnwsncantaytayaayccnwsnytnaarwsn | 837 |
| CDRH2-36 | tayathtaycaywsnggnwsncantaytayaayccnwsnytnaarwsn | 838 |
| CDRH2-37 | tayathtaycaywsnggnwsncantaytayaayccnwsnytnaarwsn | 838 |
| CDRH2-38 | tayathtaytaywsnggnwsncantaytayaayccnwsnytnaarwsn | 839 |
| CDRH2-39 | tayathcaytaywsnggnwsncantaytayaayccnwsnytnaarwsn | 840 |
| CDRH2-40 | tayathcaytaywsnggnwsncantaytayaayccnwsnytnaarwsn | 840 |
| CDRH2-41 | tayathcaywsnwsnggnwsncantaytayaayccnwsnytnaarwsn | 837 |
| CDRH2-42 | tayathcaywsnwsnggnwsncantaytayaayccnwsnytnaarwsn | 837 |
| CDRH2-43 | tayathcaytaywsnggnwsncantaytayaayccnwsnytnaarwsn | 840 |
| CDRH2-44 | tayathtaytaywsnggnggncantaytayaayccnwsnytnaarwsn | 841 |
| CDRH2-45 | tayathtaytaywsnggnggncantaytayaayccnwsnytnaarwsn | 841 |
| CDRH2-46 | garathaaycaywsnggnwsncanaaytayaayccnwsnytnaarwsn | 842 |
| CDRH2-47 | garathaaycaywsnggnwsncanaaytayaayccnwsnytnaarwsn | 842 |

FIGURE 19D

| NAME | SEQUENCE | SEQ ID NO: |
|---|---|---|
| CDRH2-48 | garathaaycaywsnggnwsncanaaytayaayccnwsnytnaarwsn | 842 |
| CDRH2-49 | garathaaycaywsnggnwsncanaaytayaayccnwsnytnaarwsn | 842 |
| CDRH2-50 | garathaaycaywsnggnwsncanaaytayaayccnwsnytnaarwsn | 842 |
| CDRH2-51 | mgnathtaycanwsnggncancanaaytayaayccnwsnytnaarwsn | 843 |
| CDRH2-52 | tayathtaytaywsnggnwsncanaaytayaayccnwsnytnaarwsn | 844 |
| CDRH2-53 | tayathtaytaywsnggnwsncanaaytayaayccnwsnytnaarwsn | 844 |
| CDRH2-54 | athathtayccngaygaywsngaycanmgntaywsnccnwsnttycarggn | 845 |
| CDRH2-55 | athathtayccngaygaywsngaygcnmgntaywsnccnwsnttycarggn | 846 |
| CDRH2-56 | athathtayccnggngaywsngayathmgntaywsnccnwsnttycarggn | 847 |
| CDRH2-57 | mgncantaytgymgnwsnaartggtayaaygaytaygcngtnwsngtnaarwsn | 848 |
| CDRH2-58 | tayathwsnwsnwsnggnmgncanathtaytaygcngaywsngtnaarggn | 834 |
| CDRH3-1 | gargayaaytggaaytayggnttyttygaytay | 849 |
| CDRH3-2 | gargayaaytggaaytayggnttyttygaytay | 849 |
| CDRH3-3 | wsnathgcngtngcnytngaytay | 850 |
| CDRH3-4 | wsnathgcngtngcnytngaytay | 850 |
| CDRH3-5 | garggngayggnggntaytaytaytayggnatggaygtn | 851 |
| CDRH3-6 | garggngayggnggntaytaytaytayggnatggaygtn | 851 |
| CDRH3-7 | atgtaywsnwsnggntggtayggngtnttygaytay | 852 |
| CDRH3-8 | gtntaywsnwsnggntggwsnttytayggnatggaygtn | 853 |
| CDRH3-9 | mgnmgngarytnccnttygaytay | 854 |
| CDRH3-10 | mgnaaytggcanccnttygaytay | 855 |
| CDRH3-11 | mgnytngarytnccnttygaytay | 856 |
| CDRH3-12 | mgnmgngargtnccnttygaytay | 857 |
| CDRH3-13 | mgncaycanaayccnttygartay | 858 |
| CDRH3-14 | mgnggngarytnccnttygaytay | 859 |
| CDRH3-15 | mgnggngarytnccnttygaytay | 859 |
| CDRH3-16 | gaymgngtnggngcncanccngaygcnttygayath | 860 |

FIGURE 19E

| NAME | SEQUENCE | SEQ ID NO: |
|---|---|---|
| CDRH3-17 | garggnathgcngtngcnggncangcngartaytaytaytay taygcnatggaygtn | 861 |
| CDRH3-18 | garggnathgcngcnmgngaywsntaytaytaytaygcnatg gaygtn | 862 |
| CDRH3-19 | garggnathgcnggnmgngaywsntaytaytayggnatg gaygtn | 863 |
| CDRH3-20 | garggnathgcnggnmgngaywsntaytaytayggnatg gaygtn | 863 |
| CDRH3-21 | wsntaytaygaywsnwsnggntaytaytayggnttygaytay | 864 |
| CDRH3-22 | wsntaytaygaywsnwsnggntaytaytayggnttygaytay | 864 |
| CDRH3-23 | aaygtnathgaytay | 865 |
| CDRH3-24 | ggnggngcncanggngcngartayttycarcay | 866 |
| CDRH3-25 | ggnggngcncanggngcngartayttycarcay | 866 |
| CDRH3-26 | ytntggttyggngarcanttygaytay | 867 |
| CDRH3-27 | aayytnccnttygaytay | 868 |
| CDRH3-28 | wsncaytayggnggngaytaygaytaytayggnatggaygtn | 869 |
| CDRH3-29 | gayggntggcarcarcargcnccnttygaytay | 870 |
| CDRH3-30 | tggggnathwsngcnccnttygaytgy | 871 |
| CDRH3-31 | tgggcnccnttygaytay | 872 |
| CDRH3-32 | gayggntayaaytggaayggnggnggnaaytaytayggnatg gaygtn | 873 |
| CDRH3-33 | gayggntayaaytggaayaayggnggntaytaytayggnatg gaygtn | 874 |
| CDRH3-34 | gayggntayaaytggaayaayggnggntaytaytayggnatg gaygtn | 874 |
| CDRH3-35 | ggnccntaytayggnatggaygtn | 875 |
| CDRH3-36 | gcnytnmgnggnathgtnytnatggtntaygtnytnggngcn ytngayath | 876 |
| CDRH3-37 | gcnytnmgnggnathgtnytnatggtntaygtnytnggngcn ytngayath | 876 |
| CDRH3-38 | gaygarcangtngtnmgnggnytnathmgntaytgytayggn atggaygtn | 877 |
| CDRH3-39 | gaymgnggnggnggngaytayggnmgnatggaygtn | 878 |
| CDRH3-40 | gaymgnggnggnggngaytayggnmgnatggaygtn | 878 |
| CDRH3-41 | wsnaayaaytayggntgyttygcnytn | 879 |
| CDRH3-42 | wsnaayaaytayggntgyttygcnytn | 879 |
| CDRH3-43 | ggntayaaytayggnytntaytaytaygaywsnwsnggntay ccnwsntaytaytayggnatggaygtn | 880 |
| CDRH3-44 | cantaytaygayathytncanggntayccnttytayttygay tay | 881 |

FIGURE 19F

| NAME | SEQUENCE | SEQ ID NO: |
|---|---|---|
| CDRH3-45 | cantaytaygayathytncanggntayccnttytayttygaytay | 881 |
| CDRH3-46 | ggnggntaywsnwsnwsntggtaytggttygayccn | 882 |
| CDRH3-47 | ggnggntaywsnwsnwsntggttytggttygayccn | 883 |
| CDRH3-48 | ggnggntaywsnwsnwsntggttytggttygayccn | 883 |
| CDRH3-49 | ggnggntaywsnwsnwsntggttytggttygayccn | 883 |
| CDRH3-50 | ggnggntaywsnwsnwsntggttytggttygayccn | 883 |
| CDRH3-51 | gayggntaywsntayggncaytaytaytayggnatggaygtn | 884 |
| CDRH3-52 | wsngcnytnmgntayttygaytggytnttywsngaygtnwsngayath | 885 |
| CDRH3-53 | wsngcnytnmgntayttygaytggytnttywsngaygtnwsngayath | 885 |
| CDRH3-54 | caraarwsntayggntaywsntayttygaytay | 886 |
| CDRH3-55 | carggntayggnwsnggntggggntayttygaytay | 887 |
| CDRH3-56 | carggnytngcngtngcnggncanwsntaytaytaytayggnatggaygtn | 888 |
| CDRH3-57 | gaymgngcngtngcnggntaytaytayggnatggaygtn | 889 |
| CDRH3-58 | tgggcnccnttygaytay | 872 |

FIGURE 19G

LIGHT CHAIN FR NUCLEOTIDE SEQUENCES

| NAME | SEQUENCE | SEQ ID NO: |
|------|----------|------------|
| FRL1-1 | gaygtngtnatgcancarwsnccnytnwsnytnccngtncanytnggncarccngcnwsnathwsntgy | 919 |
| FRL1-2 | gaygtngtnatgcancarwsnccnytnwsnytnccngtncanytnggncarccngcnwsnathwsntgy | 919 |
| FRL1-3 | gaygtngtnatgcancarwsnccnytnwsnytnccngtncanytnggncarccngcnwsnathwsntgy | 920 |
| FRL1-4 | gaygtngtnatgcancarwsnccnytnwsnytnccngtncanytnggncarccngcnwsnathwsntgy | 920 |
| FRL1-5 | gayathgtnatgcancarcanccnytnwsnytnwsngtncanccnggncarccngcnwsnathwsntgy | 921 |
| FRL1-6 | gayathgtnatgcancarcanccnytnwsnytnwsngtncanccnggncarccngcnwsnathwsntgy | 921 |
| FRL1-7 | gayathgtnatgcancarcanccnytnwsnytnwsngtncanccnggncarccngcnwsnathwsntgy | 921 |
| FRL1-8 | gayathgtnatgcancarcanccnytnwsnytnwsngtncanccnggncarccngcnwsnathwsntgy | 922 |
| FRL1-9 | gayathgtnatgcancarcanccnytnwsnytnwsngtncanccnggncarccngcnwsnathwsntgy | 922 |
| FRL1-11 | gayathcaratgcancarwsnccnwsnwsnytnwsngcnwsngtnggngaymgngtncanathcantgy | 923 |
| FRL1-12 | gayathcaratgcancarwsnccnwsnwsnytnwsngcnwsngtnggngaymgngtncanathathtgy | 923 |
| FRL1-13 | aayathgtnatgcancarcanccnytnwsnwsnccngtncanytnggncarccngcnwsnathwsntgy | 924 |
| FRL1-14 | aayathgtnatgcancarcanccnytnwsnwsnccngtncanytnggncarccngcnwsnathwsntgy | 924 |
| FRL1-15 | garathgtnatgcancarcanccnytnwsnwsnccngtncanytnggncarccngcnwsnathwsntgy | 924 |
| FRL1-16 | garathgtnytncancarwsnccnggncanytnwsnytnwsnccnggngarmgngcncanytnwsntgy | 925 |
| FRL1-17 | garathgtnytncancarwsnccnggncanytnwsnytnwsnccnggngarmgngcncanytnwsntgy | 926 |
| FRL1-18 | gayathcaratgcancarwsnccnwsnwsnytnwsngcnwsngtnggngaymgngtncanathcantgy | 927 |
| FRL1-19 | gayathgtnatgcancarwsnccngaywsnytngcngtnwsnytnggngarmgngcncanathaaytgy | 928 |

FIGURE 20A

| NAME | SEQUENCE | SEQ ID NO: |
|---|---|---|
| FRL1-20 | gayathgtnatgcancarwsnccngaywsnytngcngtnwsnytnggn garmgngcncanathaaytgy | 928 |
| FRL1-21 | gayathgtnatgcancarwsnccngaywsnytngcngtnwsnytnggn garmgngcncanathaaytgy | 929 |
| FRL1-22 | gayathgtnatgcancarwsnccngaywsnytngcngtnwsnytnggn garmgngcncanathaaytgy | 929 |
| FRL1-23 | gayathgtnatgcancarwsnccngaywsnytngcngtnwsnytnggn garmgngcncanathaaytgy | 929 |
| FRL1-24 | gayathgtnatgcancarwsnccngaywsnytncangtnwsnytnggn garmgngcncanathaaytgy | 929 |
| FRL1-25 | gayathgtnatgcancarwsnccngaywsnytncangtnwsnytnggn garmgngcncanathaaytgy | 929 |
| FRL1-26 | gayathgtnatgcancarwsnccngaywsnytngcngtnwsnytnggn garmgngcncanathaaytgy | 929 |
| FRL1-27 | gayathgtnatgcancarwsnccngaywsnytngcngtnwsnytnggn garmgngcncanathaaytgy | 929 |
| FRL1-28 | gayathgtnatgcancarwsnccngaywsnytngcngtnwsnytnggn garmgngcncanathaaytgy | 930 |
| FRL1-29 | gayathgtnatgcancarwsnccngaywsnytngcngtnwsnytnggn garmgngcncanathaaytgy | 930 |
| FRL1-30 | gayathgtnatgcancarwsnccngaywsnytngcngtnwsnytnggn garmgngcncanathaaytgy | 929 |
| FRL1-31 | gayathgtnatgcancarwsnccngaywsnytngcngtnwsnytnggn garmgngcncanathaaytgy | 929 |
| FRL1-32 | gayathgtnatgcancarwsnccngaywsnytngcngtnwsnytnggn garmgngcncanathaaytgy | 929 |
| FRL1-33 | gayathgtnatgcancarwsnccngaywsnytngcngtnwsnytnggn garmgngcncanathaaytgy | 929 |
| FRL1-34 | gayathcaratgcancarwsnccnwsnwsnytnwsngcnwsngtnggn gaymgngtncanathcantgy | 931 |
| FRL1-35 | gayathcaratgcancarwsnccnwsnwsnytnwsngcnwsngtnggn gaymgngtngcnathcantgy | 932 |
| FRL1-36 | garathgtnatgcancarwsnccgcncanytnwsngtnwsnccnggn garmgngcncanytnwsntgy | 933 |
| FRL1-37 | garathgtnatgcancarwsnccgcncanytnwsngtnwsnccnggn garmgngcncanytnwsntgy | 933 |
| FRL1-38 | gayathcaratgcancarwsnccnwsnwsngtnwsngcnwsngtnggn gaymgngtncanathcantgy | 934 |

FIGURE 20B

| NAME | SEQUENCE | SEQ ID NO: |
|---|---|---|
| FRL1-39 | gayathcaratgcancarwsnccnwsnwsnytnwsngcnwsngtnggn gaymgngtncanathcantgy | 935 |
| FRL1-40 | gayathcaratgcancarwsnccnwsnwsnytnwsngcnwsnytnggn gaymgngtncanathcantgy | 934 |
| FRL1-41 | gayathcaratgcancarwsnccnwsnwsnytnwsngcnwsngtnggn gaymgngtncanathcantgy | 936 |
| FRL1-42 | gayathcaratgcancarwsnccnwsnwsnmgnwsngcnwsngtnggn gaymgngtncanathcantgy | 934 |
| FRL1-43 | gayathcaratgcancarwsnccnwsnwsnytnwsngcnwsngtnggn gaymgngtncanathcantgy | 937 |
| FRL1-44 | gayathcaratgcancarwsnccnwsnwsnytnwsngcnwsngtnggn gaymgngtncanathcantgy | 934 |
| FRL1-45 | gayathcaratgcancarwsnccnwsnwsnytnwsngcnwsngtnggn gaymgngtncanathcantgy | 934 |
| FRL1-46 | gayathcaratgcancarwsnccnwsnwsnytnwsngcnwsngtnggn gaymgngtncanathcantgy | 934 |
| FRL1-47 | gayathcaratgcancarwsnccnwsnwsnytnwsngcnwsngtnggn gaymgngtncanathcantgy | 934 |
| FRL1-48 | gayathcaratgcancarwsnccnwsnwsnytnwsngcnwsngtnggn gaymgngtncanathcantgy | 934 |
| FRL1-49 | gayathcaratgcancarwsnccnwsnwsnytnwsngcnwsngtnggn gaymgngtncanathcantgy | 934 |
| FRL1-50 | gayathcaratgcancarwsnccnwsnwsnytnwsngcnwsngtnggn gaymgngtncanathcantgy | 934 |
| FRL1-51 | gayathcaratgcancarwsnccnwsnwsnytnwsngcnwsngtnggn gaymgngtncanathcantgy | 934 |
| FRL1-52 | gayathcaratgcancarwsnccnwsnwsnytnwsngcnwsngtnggn gaymgngtncanathcantgy | 934 |
| FRL1-53 | gayathcaratgcancarwsnccnwsnwsnytnwsngcnwsngtnggn gaymgngtncanathcantgy | 934 |
| FRL1-54 | gayathcaratgcancarwsnccnwsnwsnytnwsngcnwsngtnggn gaymgngtncanathcantgy | 934 |
| FRL1-55 | gayathcaratgcancarwsnccnwsnwsnytnwsngcnwsngtnggn gaymgngtncanathcantgy | 934 |
| FRL1-56 | gayathcaratgcancarwsnccnwsnwsnytnwsngcnwsngtnggn gaymgngtncanathcantgy | 938 |
| FRL1-57 | gayathcaratgcancarwsnccnwsnwsnytnwsngcnwsngtnggn gaymgngtncanathcantgy | 934 |

FIGURE 20C

| NAME | SEQUENCE | SEQ ID NO: |
|---|---|---|
| FRL1-58 | gayathcaratgcancarwsnccnwsnwsnytnwsngcnwsngtnggn gaymgngtngcnathcantgy | 934 |
| FRL1-59 | gayathcaratgcancarwsnccnwsnwsnytnwsngcnwsngtnggn gaymgngtngcnathcantgy | 934 |
| FRL1-60 | gayathcaratgcancarwsnccnwsnwsnytnwsngcnwsngtnggn gaymgngtncanathcantgy | 934 |
| FRL1-61 | gayathcaratgcancarwsnccnwsnwsnytnwsngcnwsngtnggn gaymgngtncanathcantgy | 934 |
| FRL1-62 | gayathcaratgcancarwsnccnwsnwsnytnwsngcnwsngtnggn gayggngtncanathcantgy | 934 |
| FRL1-63 | gayathcaratgcancarwsnccnwsnwsnytnwsngcnwsngtnggn gaymgngtncanathcantgy | 939 |
| FRL1-64 | gayathcaratgcancarwsnccnwsnwsnytnwsngcnwsngtnggn gaymgngtncanathcantgy | 934 |
| FRL1-65 | gayathcaratgcancarwsnccnwsnwsnytnwsngcnwsngtnggn gaymgngtncanathcantgy | 934 |
| FRL2-1 | tggttycarcarmgnccnggncarwsnccnmgnmgnytnathtay | 939 |
| FRL2-2 | tggttycarcarmgnccnggncarwsnccnmgnmgnytnathtay | 939 |
| FRL2-3 | tggytncarcarmgnccnggncarwsnccnmgnmgnytnathtay | 940 |
| FRL2-4 | tggytncarcarmgnccnggncarwsnccnmgnmgnytnathtay | 940 |
| FRL2-5 | tggtayytncaraarccnggncarccnccncarytnytnathtay | 941 |
| FRL2-6 | tggtayytncaraarccnggncarccnccncarytnytnathtay | 941 |
| FRL2-7 | tggtayytncaraarccnggncarccnccncarytnytnathtay | 941 |
| FRL2-8 | tggttyytncaraarccnggncarccnccncarccnytnathtay | 942 |
| FRL2-9 | tggttyytncaraarccnggncarccnccncarccnytnathtay | 942 |
| FRL2-11 | tggtaycarcaraarccnggnaargtnccnaarytnytnathtay | 943 |
| FRL2-12 | tggtaycarcaraarccnggnaargtnccnaarytnytnathtay | 943 |
| FRL2-13 | tggytncarcarmgnccnggncarccnccnmgnytnytnathtay | 944 |
| FRL2-14 | tggytncarcarmgnccnggncarccnccnmgnytnytnathtay | 944 |
| FRL2-15 | tggytncarcarmgnccnggncarccnccnmgnytnytnathtay | 944 |
| FRL2-16 | tggtaycarcaraarccnggncargcnccnmgnytnytnathwsn | 945 |
| FRL2-17 | tggtaycarcaraarccnggncargcnccnmgnytnytnathtay | 946 |
| FRL2-18 | tggtaycarcaraarccnggnaargcnccnaarmgnytnathtay | 947 |
| FRL2-19 | tggtaycarcaraarccnggncarccnccnaarytnttyathtay | 948 |
| FRL2-20 | tggtaycarcaraarccnggncarccnccnaarytnttyathtay | 948 |
| FRL2-21 | tggtaycarcaraarccnggncarccnccnaarytnytnathtay | 949 |
| FRL2-22 | tggtaycarcaraarccnggncarccnccnaarytnytnathtay | 949 |
| FRL2-23 | tggtaycarcaraarccnggncarccnccnaarytnytnathtay | 949 |

FIGURE 20D

| NAME | SEQUENCE | SEQ ID NO: |
|---|---|---|
| FRL2-24 | tggtaycarcaraarccnggncarccnccnaarytnytnathtay | 949 |
| FRL2-25 | tggtaycarcaraarccnggncarccnccnaarytnytnathtay | 949 |
| FRL2-26 | tggtaycarcaraarccnggncarccnccnaarytnytnathtay | 949 |
| FRL2-27 | tggtaycarcaraarccnggncarccnccnaarytnytnathtay | 949 |
| FRL2-28 | tggtaycarcaraarccnggncarccnccnaargtnytnathtay | 950 |
| FRL2-29 | tggtaycarcaraarccnggncarccnccnaargtnytnathtay | 950 |
| FRL2-30 | tggtaycarcaraarccnggncarccnccnaarytnytnathtay | 949 |
| FRL2-31 | tggtaycarcaraarccnggncarccnccnaarytnytnathtay | 949 |
| FRL2-32 | tggtaycarcaraarccnggncarccnccnaarytnytnathtay | 949 |
| FRL2-33 | tggtaycarcaraarccnggncarccnccnaarytnytnathtay | 949 |
| FRL2-34 | tggttycarcaraarccnggnaargcnccnaarwsnytnathtay | 951 |
| FRL2-35 | tggytncarcaraarccnggnaargcnccnaarwsnytnathtay | 952 |
| FRL2-36 | tggtaycarcargayccnggncargcnccnmgnytnytnathtay | 953 |
| FRL2-37 | tggtaycarcargayccnggncargcnccnmgnytnytnathtay | 953 |
| FRL2-38 | tggtaycarcaraarccnggnaargcnccnaarytnytnathtay | 954 |
| FRL2-39 | tggtaycarcaraarccnggnaargcnccnaarttyytnathtay | 955 |
| FRL2-40 | tggtaycarcaraarccnggnaargcnccnaarytnytnathtay | 954 |
| FRL2-41 | tggtaycarcarmgnccnggnaaygcnccnaarytnytnathtay | 956 |
| FRL2-42 | tggtaycarcaraarccnggnaargcnccnaarytnytnathtay | 954 |
| FRL2-43 | tggtaycarcaraarccnggnaargcnccnaargtnytnathtay | 957 |
| FRL2-44 | tggtaycarcaraarccnggnaargcnccnaarytnytnathtay | 954 |
| FRL2-45 | tggtaycarcaraarccnggnaargcnccnaarytnytnathtay | 954 |
| FRL2-46 | tggtaycarcaraarccnggnaargcnccnaarytnytnathtay | 954 |
| FRL2-47 | tggtaycarcaraarccnggnaargcnccnaarytnytnathtay | 954 |
| FRL2-48 | tggtaycarcaraarccnggnaargcnccnaarytnytnathtay | 954 |
| FRL2-49 | tggtaycarcaraarccnggnaargcnccnaarytnytnathtay | 954 |
| FRL2-50 | tggtaycarcaraarccnggnaargcnccnaarytnytnathtay | 954 |
| FRL2-51 | tggtaycarcaraarccnggnaargcnccnaarytnytnathtay | 954 |
| FRL2-52 | tggtaycarcaraarccnggnaargcnccnaarytnytnathtay | 954 |
| FRL2-53 | tggtaycarcaraarccnggnaargcnccnaarytnytnathtay | 954 |
| FRL2-54 | tggtaycarcaraarccnggnaargcnccnaarytnytnathtay | 954 |
| FRL2-55 | tggtaycarcaraarccnggnaargcnccnaarytnytnathtay | 954 |
| FRL2-56 | tggtaycarcaraarccnggnaargcnccngarytnytnathtay | 958 |
| FRL2-57 | tggtaycarcaraarccnggnaargcnccnaarytnytnathtay | 954 |
| FRL2-58 | tggtaycarcaraarccnggnaargcnccnaarytnytnathtay | 954 |
| FRL2-59 | tggtaycarcaraarccnggnaargcnccnaarytnytnathtay | 954 |

FIGURE 20E

| NAME | SEQUENCE | SEQ ID NO: |
|---|---|---|
| FRL2-60 | tggtaycarcaraarccnggnaargcnccnaarytnytnathtay | 954 |
| FRL2-61 | tggtaycarcaraarccnggnaargcnccnaarytnytnathtay | 954 |
| FRL2-62 | tggtaycarcaraarccnggnaargcnccnaarytnytnathtay | 954 |
| FRL2-63 | tggtaycarcaraarytnggnaargcnccnaarytnytnathcay | 959 |
| FRL2-64 | tggtaycarcaraarccnggnaargcnccnaarytnytnathtay | 954 |
| FRL2-65 | tggtaycarcaraarccnggnaargcnccnaarytnytnathtay | 954 |
| FRL3-1 | ggngtnccngaymgnttyaayggnwsnggnwsnggncangayttycan ytnaarathwsnmgngtngargcngargaygtnggngtntaytaytgy | 960 |
| FRL3-2 | ggngtnccngaymgnttywsnggnwsnggnwsnggncangayttycan ytnaarathwsnmgngtngargcngargaygtnggngtntaytaytgy | 961 |
| FRL3-3 | ggngtnccngaymgnttywsnggnwsnggnwsnggncangayttycan ytnaarathwsnmgngtngargcngargaygtnggngtntaytaytgy | 961 |
| FRL3-4 | ggngtnccngaymgnttywsnggnwsnggnwsnggncangayttycan ytnaarathwsnmgngtngargcngargaygtnggngtntaytaytgy | 961 |
| FRL3-5 | ggngtnccngaymgnttywsnggnwsnggnwsnggncangayttycan ytnaarathwsnmgngtngargcngargaygtnggngtntaytaytgy | 961 |
| FRL3-6 | ggngtnccngaymgnttywsnggnwsnggnwsnggncangayttycan ytnaarathwsnmgngtngargcngargaygtnggngtntaytaytgy | 961 |
| FRL3-7 | ggngtnccngaymgnttywsnggnwsnggnwsnggncangayttycan ytnaarathwsnmgngtngargcngargaygtnggngtntaytaytgy | 961 |
| FRL3-8 | ggngtnccngaymgnttywsnggnwsnggnwsnggncangayttycan ytnaarathwsnmgngtngargcngargaygtnggngtntaytaytgy | 961 |
| FRL3-9 | ggngtnccngaymgnttywsnggnwsnggnwsnggncangayttycan ytnaarathwsnmgngtngargcngargaygtnggngtntaytaytgy | 961 |
| FRL3-11 | ggngtnccnwsnmgnttywsnggnwsnggnwsnggncangayttycan ytncanathwsnwsnytncarccngargaygtngcncantaytaytgy | 962 |
| FRL3-12 | ggngtnccnwsnmgnttywsnggnwsnggnwsnggncangayttycan ytncanathwsnwsnytncarccngargaygtngcncantaytaytgy | 962 |
| FRL3-13 | ggngtnccngaymgnttywsnggnwsnggngcnggncangayttycan ytnaarathwsnmgngtngargcngargaygtnggngtntaytaytgy | 963 |
| FRL3-14 | ggngtnccngaymgnttywsnggnwsnggngcnggncangayttycan ytnaarathwsnmgngtngargcngargaygtnggngtntaytaytgy | 963 |
| FRL3-15 | ggngtnccngaymgnttywsnggncanggngcnggncangayttycan ytnaarathwsnmgngtngargcngargaygtnggngtntaytaytgy | 964 |
| FRL3-16 | ggnathccngaymgnttywsnggnwsnggnwsnggncangayttycan ytncanathwsnmgnytngarccngargayttygcngtntaytaytgy | 965 |
| FRL3-17 | ggnathccngaymgnttywsnggnwsnggnwsnggncangayttycan ytncanathwsnmgnytngarccngargayttygcngtntaytaytgy | 965 |

FIGURE 20F

| NAME | SEQUENCE | SEQ ID NO: |
|---|---|---|
| FRL3-18 | ggngtnccnwsnmgnttywsnggnwsnggnwsnggncangarttycan ytncanathwsnwsnytncarccngargayttygcncantaytaytgy | 966 |
| FRL3-19 | ggngtnccngaymgnttycanggnwsnggnwsnggncangayttycan ytncanathwsnwsnytncargcngargaygtngcngtntaytaytgy | 967 |
| FRL3-20 | ggngtnccngaymgnttycanggnwsnggnwsnggncangayttycan ytncanathwsnwsnytncargcngargaygtngcngtntaytaytgy | 967 |
| FRL3-21 | ggngtnccngaymgnttywsnggnwsnggnwsnggncangayttycan ytncanathwsnwsnytncargcngargaygtngcngtntaytaytgy | 968 |
| FRL3-22 | ggngtnccngaymgnttywsnggnwsnggnwsnggncangayttycan ytncanathwsnwsnytncargcngargaygtngcngtntayttytgy | 969 |
| FRL3-23 | ggngtnccngaymgnttywsnggnwsnggnwsnggncangayttycan ytncanathwsnwsnytncargcngargaygtngcngtntayttytgy | 969 |
| FRL3-24 | ggngtnccngaymgnttyggnggnwsnggnwsnggncangayttycan ytncanathwsnwsnytncargcngargaygtngcngtntaytaytgy | 970 |
| FRL3-25 | ggngtnccngaymgnttyggnggnwsnggnwsnggncangayttycan ytncanathwsnwsnytncargcngargaygtngcngtntaytaytgy | 970 |
| FRL3-26 | ggngtnccngaymgnttywsnggnwsnggnwsnggncangayttycan ytncanathwsnwsnytncargcngaygaygtngcngtntaytaytgy | 971 |
| FRL3-27 | ggngtnccngaymgnttywsnggnwsnggnwsnggncangayttycan ytncanathwsnwsnytncargcngaygaygtngcngtntaytaytgy | 971 |
| FRL3-28 | ggngtnccngaymgnttywsnggnwsnggnwsnggncangayttycan ytncanathwsnggnytncargcngargaygtngcnytntaytaytgy | 972 |
| FRL3-29 | ggngtnccngaymgnttywsnggnwsnggnwsnggncangayttycan ytncanathwsnggnytncargcngargaygtngcnytntaytaytgy | 972 |
| FRL3-30 | ggngtnccngaymgnttywsnggnwsnggnwsnggncangayttycan ytncanathwsnwsnytncargcngargaygtngcngtntttytaytgy | 973 |
| FRL3-31 | ggngtnccngaymgnttywsnggnwsnggnwsnggncangayttycan ytncanathwsnwsnytncargcngargaygtngcngtntttytaytgy | 973 |
| FRL3-32 | ggngtnccngaymgnttywsnggnwsnggnwsnggncangayttycan ytncanathwsnwsnytncargcngargaygtngcngtntayttytgy | 969 |
| FRL3-33 | ggngtnccngaymgnttywsnggnwsnggnwsnggncangayttycan ytncanathwsnwsnytncargcngargaygtngcngtntayttytgy | 969 |
| FRL3-34 | ggngtnccnwsnaarttywsnggnwsnggnwsnggncangayttycan ytncanathwsnwsnytncarccngargayttygcncantaytaytgy | 974 |
| FRL3-35 | ggngtnccnwsnmgnttywsnggnwsnggnwsnggncangayttycan ytncanathwsnwsnytncarccngargayttygcncantaytaytgy | 975 |
| FRL3-36 | ggnathccngcnmgnttywsnggnwsnggnwsnggncangarttycan ytncanathwsnwsnytncarwsngargayttygcngtntaytaytgy | 976 |

FIGURE 20G

| NAME | SEQUENCE | SEQ ID NO: |
|---|---|---|
| FRL3-37 | ggnathccngcnmgnttywsnggnwsnggnwsnggncangarttycan ytncanathwsnwsnytncarwsngargayttygcngtntaytaytgy | 976 |
| FRL3-38 | ggngtnccnwsnmgnttywsnggnwsnggnwsnggncangayttycan ytncanathwsnwsnytncarccngargayttygcncantaytaytgy | 975 |
| FRL3-39 | ggngtnccnwsnmgnttywsnggnwsnggnwsnggncangayttycan ytncanathwsnwsnytncarccngargayttygcngcntaytaytgy | 977 |
| FRL3-40 | ggngtnccnwsnmgnttywsnggnwsnggnwsnggncangayttycan ytncanathwsnwsnytncarccngargayttygcncantaytaytgy | 975 |
| FRL3-41 | ggngtnccnwsnmgngtnwsnggnwsnggnwsnggncangayttycan ytncanathmgnwsnytncarccngargayttygcncantaytaytgy | 978 |
| FRL3-42 | ggngtnccnwsnmgnttywsnggnwsnggnwsnggncangayttycan ytncanytnwsnwsnytncarccngargayttygcncantaytaytgy | 979 |
| FRL3-43 | ggngtnccnwsnmgnttywsnggnwsnggnwsnggncangayttycan ytncanathwsnwsnytncarccngargayttygcncantaytaytgy | 975 |
| FRL3-44 | ggngtnccnwsnmgnttywsnggnwsnggnwsnggncangayttycan ytncanathwsnwsnytncarccngaraayttygcncantaytaytgy | 980 |
| FRL3-45 | ggngtnccnwsnmgnttywsnggnwsnggnwsnggncangayttycan ytncanttywsnwsnytncarccngargayttygcncantaytaytgy | 981 |
| FRL3-46 | ggngtnccnwsnmgnttywsnggnwsnggnwsnggncangayttycan ytncanytnwsnwsnytncarccngargayttygcnwsntaytaytgy | 982 |
| FRL3-47 | ggngtnccnwsnmgnttywsnggnwsnggnwsnggncangayttycan ytncanytnwsnwsnytncarccngargayttygcnwsntaytaytgy | 982 |
| FRL3-48 | ggngtnccnwsnmgnttywsnggnwsnggnwsnggncangayttycan ytncanathwsnwsnytncarccngargayttygcncantaytaytgy | 975 |
| FRL3-49 | ggngtnccnwsnmgnttywsnggnwsnggnwsnggncangayttycan ytncanathwsnwsnytncarccngargayttygcncantaytaytgy | 975 |
| FRL3-50 | ggngtnccnwsnmgnttywsnggnwsnggnwsnggncangayttycan ytncanathwsnwsnytncarccngargayttygcncantaytaytgy | 975 |
| FRL3-51 | ggngtnccnwsnmgnttywsnggnwsnggnwsnggncangayttycan ytncanathwsnwsnytncarccngargayttygcnwsntaytaytgy | 983 |
| FRL3-52 | ggngtnccnwsnmgnttywsnggnwsnggnwsnggncangayttycan ytncanathwsnwsnytncarccngargayttygcnwsntaytaytgy | 983 |
| FRL3-53 | ggngtnccnwsnmgnttywsnggnwsnggnwsnggncangayttycan ytncanathwsnwsnytncarccngargayttygcncantaytaytgy | 975 |
| FRL3-54 | ggngtnccnwsnmgnttywsnggnwsnggnwsnggncangayttycan ttycanathwsnwsnytncarccngargayathgcncantaytaytgy | 984 |
| FRL3-55 | ggngtnccnwsnmgnttywsnggnwsnggnwsnggncangayttycan ttycanathwsnwsnytncarccngargayathgcncantaytaytgy | 984 |

FIGURE 20H

| NAME | SEQUENCE | SEQ ID NO: |
|---|---|---|
| FRL3-56 | ggngtnccnwsnmgnttywsnggnwsnggnwsnggncangayttycan ttycanathwsnwsnytncarccngargayathgcncantaytaytgy | 984 |
| FRL3-57 | ggngtnccnwsnmgnttywsnggnwsnggnwsnggncangayttycan ttycanathwsnwsnytncarccngargayathgcncantaytaytgy | 984 |
| FRL3-58 | ggngtnccnwsnmgnttywsnggnwsnggnwsnggncangayttycan ttycanathwsnwsnytncarccngargayathgcncantaytaytgy | 984 |
| FRL3-59 | ggngtnccnwsnmgnttywsnggnwsnggnwsnggncangayttycan ttycanathwsnwsnytncarccngargayathgcncantaytaytgy | 984 |
| FRL3-60 | ggngtnccnwsnmgnttywsnggnwsnggnwsngarcangayttycan ttycanathwsnwsnytncarccngargayathgcncantaytaytgy | 985 |
| FRL3-61 | ggngtnccnwsnmgnttywsnggnwsnggnwsnggncangayttycan ttycanathwsnwsnytncarccngargayathgcncantaytaytgy | 984 |
| FRL3-62 | ggngtnccnwsnmgnttywsnggnwsnggnwsnggncangayttycan ttycanathwsnwsnytncarccngargayathgcncantaytaytgy | 984 |
| FRL3-63 | ggngtnccnwsnmgnttywsnggnwsnggnwsnggncangayttycan ttycanathwsnwsnytncarccngargayathgcncantaytaytgy | 984 |
| FRL3-64 | ggngtnccnwsnmgnttywsnggnwsnggnwsnggncangayttycan ttycanathwsnwsnytncarccngargayathgcncantaytaytgy | 984 |
| FRL3-65 | ggngtnccnwsnmgnttywsnggnwsnggnwsnggncangayttycan ttycanathwsnwsnytncarccngargayathgcncantaytaytgy | 984 |
| FRL4-1 | ttyggncarggncanmgnytngarathaar | 986 |
| FRL4-2 | ttyggncarggncanmgnytngarathaar | 986 |
| FRL4-3 | ttyggncarggncanmgnytngarathaar | 986 |
| FRL4-4 | ttyggncarggncanmgnytngarathaar | 986 |
| FRL4-5 | ttyggncarggncanaarytngarathaar | 988 |
| FRL4-6 | ttyggnggnggncanaargtngarathaar | 989 |
| FRL4-7 | ttyggnggnggncanaargtngarathaar | 989 |
| FRL4-8 | ttyggncayggncanmgnytngarathaar | 990 |
| FRL4-9 | ttyggncayggncanmgnytngarathaar | 990 |
| FRL4-11 | ttyggnccnggncanaargtngayathaar | 991 |
| FRL4-12 | ttyggnggnggncanaargtngarathaar | 989 |
| FRL4-13 | ttyggnccnggncanaargtngayathaar | 991 |
| FRL4-14 | ttyggnccnggncanaargtngayathaar | 991 |
| FRL4-15 | ttyggnggnggncanaargtngarathaar | 989 |
| FRL4-16 | ttyggncarggncanaargtngarathaar | 992 |
| FRL4-17 | ttyggncarggncanaarytngarathaar | 988 |
| FRL4-18 | ttyggncarggncanaargtngarathaar | 992 |
| FRL4-19 | ttyggncarggncanaargtngarathaar | 992 |
| FRL4-20 | ttyggncarggncanaargtngarathaar | 992 |

FIGURE 20I

| NAME | SEQUENCE | SEQ ID NO: |
|---|---|---|
| FRL4-21 | ttyggncarggncanaargtngarathaar | 992 |
| FRL4-22 | ttyggncarggncanaargtngarathaar | 992 |
| FRL4-23 | ttyggncarggncanaargtngarathaar | 992 |
| FRL4-24 | ttyggncarggncanaargtngarathaar | 992 |
| FRL4-25 | ttyggncarggncanaargtngarathaar | 992 |
| FRL4-26 | ttyggccnggncanaargtngarathaar | 993 |
| FRL4-27 | ttyggccnggncanaargtngarathaar | 993 |
| FRL4-28 | ttyggncarggncanaarytngarathaar | 988 |
| FRL4-29 | ttyggncarggncanaarytngarathaar | 988 |
| FRL4-30 | ttyggngnggncanaargtngcnathaar | 994 |
| FRL4-31 | ttyggngnggncanaargtngcnathaar | 994 |
| FRL4-32 | ttyggngnggncanaargtngarathaar | 989 |
| FRL4-33 | ttyggngnggncanaargtngarathaar | 989 |
| FRL4-34 | ttyggccnggncanaargtngayathaar | 991 |
| FRL4-35 | ttyggccnggncanaaratggayathaar | 995 |
| FRL4-36 | ttyggncarggncanaargtngarathaar | 992 |
| FRL4-37 | ttyggncarggncanaargtngarathaar | 992 |
| FRL4-38 | ttyggncarggncanaargtngarttyaar | 996 |
| FRL4-39 | ttyggccnggncanaargtngayathaar | 991 |
| FRL4-40 | ttyggngnggncanaargtngarathaar | 989 |
| FRL4-41 | ttyggngnggncanaargtngarathaar | 989 |
| FRL4-42 | ttyggncarggncanmgnytngarathaar | 986 |
| FRL4-43 | ttyggncarggncanmgnytngarathath | 987 |
| FRL4-44 | ttyggncarggncanmgnytngarathaar | 986 |
| FRL4-45 | ttyggncarggncanmgnytngarathaar | 986 |
| FRL4-46 | ttyggncarggncanmgnytngarathaar | 986 |
| FRL4-47 | ttyggncarggncanmgnytngarathaar | 986 |
| FRL4-48 | ttyggncarggncanmgnytngarathaar | 986 |
| FRL4-49 | ttyggncarggncanmgnytngarathaar | 986 |
| FRL4-50 | ttyggncarggncanmgnytngarathaar | 986 |
| FRL4-51 | ttyggncarggncanmgnytngarathaar | 986 |
| FRL4-52 | ttyggncarggncanmgnytngarathaar | 986 |
| FRL4-53 | ttyggncarggncanmgnytngarathaar | 986 |
| FRL4-54 | ttyggccnggncanaargtngayathaar | 991 |
| FRL4-55 | ttyggccnggncanaargtngayathaar | 991 |
| FRL4-56 | ttyggngnggncanaargtngarathaar | 989 |

FIGURE 20J

| NAME | SEQUENCE | SEQ ID NO: |
|---|---|---|
| FRL4-57 | ttyggnggnggncanaargtngarathaar | 989 |
| FRL4-58 | ttyggnggnggncanaargtngarathaar | 989 |
| FRL4-59 | ttyggnggnggncanaargtngarathaar | 989 |
| FRL4-60 | ttyggnggnggncanaargtngarathaar | 989 |
| FRL4-61 | ttyggnggnggncanaargtngarathmgn | 997 |
| FRL4-62 | ttyggncarggncanmgnytngarathaar | 986 |
| FRL4-63 | ttyggncarggncanmgnytngarathaar | 986 |
| FRL4-64 | ttyggncarggncanmgnytngarathaar | 986 |
| FRL4-65 | ttyggncarggncanmgnytngarathaar | 986 |

FIGURE 20K

HEAVY CHAIN FR NUCLEOTIDE SEQUENCES

| NAME | SEQUENCE | SEQ ID NO: |
|---|---|---|
| FRH1-1 | cargtncarytngtncarwsnggngcngargtnaaraarccngg ngcnwsngtnaargtnwsntgyaargcnwsn | 970 |
| FRH1-2 | cargtncarytngtncarwsnggngcngargtnaaraarccngg ngcnwsngtnaargtnwsntgyaargcnwsn | 970 |
| FRH1-3 | cargtncayytngtncarwsnggngcngargtnaaraarccngg ngcnwsngtnaargtnwsntgyaargtnwsn | 971 |
| FRH1-4 | cargtncarytngtncarwsnggngcngargtnaaraarccngg ngcnwsngtnaargtnwsntgyaargcnwsn | 970 |
| FRH1-5 | cargtncarytngtncarwsnggngcngargtnmgnaarccngg ngcnwsngtnaargtnwsntgyaargtnwsn | 972 |
| FRH1-6 | cargtncarytngtncarwsnggngcngargtnmgnaarccngg ngcnwsngtnaargtnwsntgyaargtnwsn | 972 |
| FRH1-7 | cargtncanytnaargarwsnggnccngtnytngtnaarccnca ngarcanytncanytncantgycangtnwsn | 973 |
| FRH1-8 | cargtncanytnaargarwsnggnccngtnytngtnaarccnca ngarcanytncanytncantgycangtnwsn | 973 |
| FRH1-9 | carathcanytnaargarwsnggnccncanytngtnaarccnca ncarcanytncanytncantgycanttywsn | 974 |
| FRH1-10 | carathcanytnaargarwsnggnccncanytngtnaarccnca ncarcanytncanytncantgycanttywsn | 974 |
| FRH1-11 | carathcanytnaargarwsnggnccncanytngtnaarccnca ncarcanytncanytncantgycanttywsn | 974 |
| FRH1-12 | carathcanytnaargarwsnggnccncanytngtnaarccnca ncarcanytncanytncantgycanttywsn | 974 |
| FRH1-13 | carathcanytnaargarwsnggnccncanytngtnaarccnca ncarcanytncanytncantgycanttywsn | 974 |
| FRH1-14 | carathcanytnaargarwsnggnccncanytngtnaarccnca ncarcanytncanytncantgycanttywsn | 974 |
| FRH1-15 | carathcanytnaargarwsnggnccncanytngtnaarccnca ncarcanytncanytncantgycanttywsn | 974 |
| FRH1-16 | gargtncarytngtngarwsnggnggnggnytngtnaarccngg nggnwsnytnmgnytnwsntgygcngcnwsn | 975 |
| FRH1-17 | gargtncarytnytngarwsnggnggnggnytngtncarccngg nggnwsnytnmgnytnwsntgygcngcnwsn | 976 |
| FRH1-18 | gargtncarytnytngarwsnggnggnggnytngtncarccngg nggnwsnytnmgnytnwsntgygcngcnwsn | 976 |

FIGURE 21A

| NAME | SEQUENCE | SEQ ID NO: |
|---|---|---|
| FRH1-19 | gargtncarytnytngarwsnggnggnggnytngtncarccngg nggnwsnytnmgnytnwsntgycangcnwsn | 977 |
| FRH1-20 | gargtncarytnytngarwsnggnggnggnytngtncarccngg nggnwsnytnmgnytnwsntgycangcnwsn | 977 |
| FRH1-21 | cargtncarytngtngarwsnggnggnggngtngtncarccngg nmgnwsnytnmgnytnwsntgygcngcnwsn | 978 |
| FRH1-22 | cargtncarytngtngarwsnggnggnggngtngtncarccngg nmgnwsnytnmgnytnwsntgygcngcnwsn | 978 |
| FRH1-23 | cargtncarytngtngarwsnggnggnggngtngtncarccngg nmgnwsnytnmgnytnwsntgygcngcnwsn | 978 |
| FRH1-24 | cargtncarytngtngarwsnggnggnggngtngtncarccngg nmgnwsnytnmgnytnwsntgygcngcnwsn | 978 |
| FRH1-25 | cargtncarytngtngarwsnggnggnggngtngtncarccngg nmgnwsnytnmgnytnwsntgygcngcnwsn | 978 |
| FRH1-26 | cargtncarytngtngarwsnggnggnggngtngtncarccngg nmgnwsnytnmgnytnwsntgygcngcnwsn | 978 |
| FRH1-27 | cargtncarytngtngarwsnggnggnggngtngtncarccngg nmgnwsnytnmgnytnwsntgygcngcnwsn | 978 |
| FRH1-28 | cargtncarytngtngarwsnggnggnggngtngtncarccngg nmgnwsnytnmgnytnwsntgygcngcnwsn | 978 |
| FRH1-29 | cargtncarytngtngarwsnggnggnggngtngtncarccngg nmgnwsnytnmgnytnwsntgygcngcnwsn | 978 |
| FRH1-30 | cargtncarytngtngarwsnggnggnggngtngtncarccngg nmgnwsnytnmgnytnwsntgygcngcnwsn | 978 |
| FRH1-31 | gargtncarytngtngarwsnggnggnggnytngtncarccngg nggnwsnytnmgnytnwsntgygcngcnwsn | 979 |
| FRH1-32 | gargtncarytngtngarwsnggnggnggnytngtncarccngg nggnwsnytnmgnytnwsntgygcngcnwsn | 979 |
| FRH1-33 | gargtncarytngtngarwsnggnggnggnytngtncarccngg nggnwsnytnmgnytnwsntgygcngcnwsn | 979 |
| FRH1-34 | gargtncarytngtngarwsnggnggnggnytngtncarccngg nggnwsnytnmgnytnwsntgygcngcnwsn | 979 |
| FRH1-35 | cargtncarytncargarwsnggnccnggnytngtnaarccnws ncarcanytnwsnytncantgycangtnwsn | 980 |
| FRH1-36 | cargtncarytncargarwsnggnccnggnytngtnaarccnws ncarcanytnwsnytncantgycangtnwsn | 980 |
| FRH1-37 | cargtncarytncargarwsnggnccnggnytngtnaarccnws ncarcanytnwsnytncantgycangtnwsn | 980 |

FIGURE 21B

| NAME | SEQUENCE | SEQ ID NO: |
|---|---|---|
| FRH1-38 | cargtncarytncargarwsnggnccnggnytngtnaarccnws ncarcanytnwsnytncantgycangtnwsn | 980 |
| FRH1-39 | cargtncarytncargarwsnggnccnggnytngtnaarccnws ncarcanytnwsnytnaaytgycangtnwsn | 981 |
| FRH1-40 | cargtncarytncargarwsnggnccnggnytngtnaarccnws ncarcanytnwsnytnaaytgycangtnwsn | 981 |
| FRH1-41 | cargtncarytncargarwsnggnccnggnytngtnaarccnws ncarcanytnwsnytncantgycangtnwsn | 980 |
| FRH1-42 | cargtncarytncargarwsnggnccnggnytngtnaarccnws ncarcanytnwsnytncantgycangtnwsn | 980 |
| FRH1-43 | cargtncarytncargarwsnggnccnggnytngtnaarccnws ncarcanytnwsnytncantgycangtnwsn | 980 |
| FRH1-44 | cargtncarytncargarwsnggnccnggnytngtnaarccnws ncarcanytnwsnytncantgycangtnwsn | 980 |
| FRH1-45 | cargtncarytncargarwsnggnccnggnytngtnaarccnws ncarcanytnwsnytncantgycangtnwsn | 980 |
| FRH1-46 | cargtncarytncarcartggggngcnggnytnytnaarccnws ngarcanytnwsnytncantgygcngtntay | 982 |
| FRH1-47 | cargtncarytncarcartggggngcnggnytnytnaarccnws ngarcanytnwsnytncantgygcngtntay | 982 |
| FRH1-48 | gargtncarytncarcartggggngcnggnytnytnaarccnws ngarcanytnwsnytncantgygcngtntay | 982 |
| FRH1-49 | cargtncarytncarcartggggngcnggnytnytnaarccnws ngarcanytnwsnytncantgygcngtntay | 982 |
| FRH1-50 | cargtncarytncarcartggggngcnggnytnytnaarccnws ngarcanytnwsnytncantgygcngtntay | 982 |
| FRH1-51 | cargtncarytncargarwsnggnccnggnytngtnaarccnws ngarcanytnwsnytncantgycangtnwsn | 983 |
| FRH1-52 | cargtncarytncargarwsnggnccnggnytngtnaarccnws ngarcanytnwsnytncantgycangtnwsn | 983 |
| FRH1-53 | cargtncarytncargarwsnggnccnggnytngtnaarccnws ngarcanytnwsnytncantgycangtnwsn | 983 |
| FRH1-54 | gargtncarytngtncarwsnggngcngarytnaaraarccngg ngarwsnytnaarathwsntgyaarggnwsn | 984 |
| FRH1-55 | gargtncarytngtncarwsnggngcngargtnaaraarccngg ngarwsnytnaarathwsntgyaarggnwsn | 985 |
| FRH1-56 | gargtncarytngtncarwsnggngcngargtnaaraarccngg ngarwsnytnaarathwsntgyaarggnwsn | 985 |
| FRH1-57 | cargtncarytncarcarwsnggnccnggnytngtnaarccnws ncarcanytnwsnytncantgygcnathwsn | 986 |
| FRH1-58 | gargtncarytngtngarwsnggnggnggnytngtncarccngg | 979 |

FIGURE 21C

| NAME | SEQUENCE | SEQ ID NO: |
|---|---|---|
| FRH2-1 | tgggtnmgncargcnccnggncarggnytngartggatgggn | 987 |
| FRH2-2 | tgggtnmgncargcnccnggncarggnytngartggatgggn | 987 |
| FRH2-3 | tgggtnmgncargcnccnggncarggnytngartggatgggn | 987 |
| FRH2-4 | tgggtnmgncargcnccnggncarggnytngartggatgggn | 987 |
| FRH2-5 | tgggtnmgncargcnccnggnaarggnytngartggatgggn | 988 |
| FRH2-6 | tgggtnmgncargcnccnggnaarggnytngartggatgggn | 988 |
| FRH2-7 | tggathmgncarccnccnggnaargcnytngartggytngcn | 989 |
| FRH2-8 | tggathmgncarccnccnggnaargcnytngartggytngtn | 990 |
| FRH2-9 | tggathmgncarccnccnggnaargcnytngartggytngcn | 989 |
| FRH2-10 | tggathmgncarccnccnggnaargcnytngartggytngcn | 989 |
| FRH2-11 | tggathmgncarccnccnggnaargcnytngartggytngcn | 989 |
| FRH2-12 | tggathmgncarccnccnggnaargcnytngartggytngcn | 989 |
| FRH2-13 | tggathmgncarccnccnggnaargcnytngartggytngcn | 989 |
| FRH2-14 | tggathmgncarccnccnggnaargcnytngartggytngcn | 989 |
| FRH2-15 | tggathmgncarccnccnggnaargcnytngartggytngcn | 989 |
| FRH2-16 | Tgggtnmgncargcnccnggnaarggnytngartgggtnwsn | 991 |
| FRH2-17 | tgggtnmgncargcnccnggnaarggnytngartgggtnwsn | 991 |
| FRH2-18 | tgggtnmgncargcnccnggnaarggnytngartgggtnwsn | 991 |
| FRH2-19 | tgggtnmgncargcnccnggnaarggnytngartgggtnwsn | 991 |
| FRH2-20 | tgggtnmgncargcnccnggnaarggnytngartgggtnwsn | 991 |
| FRH2-21 | tgggtnmgncargcnccnggnaarggnytngartgggtngcn | 992 |
| FRH2-22 | tgggtnmgncargcnccnggnaarggnytngartgggtngcn | 992 |
| FRH2-23 | tgggtnmgncargcnccnggnaarggnytngartgggtngcn | 992 |
| FRH2-24 | tgggtnmgncargcnccnggnaarggnytngartgggtngcn | 992 |
| FRH2-25 | tgggtnmgncargcnccnggnaarggnytngartgggtngcn | 992 |
| FRH2-26 | tgggtnmgncargcnccnggnaarggnytngartgggtngcn | 992 |
| FRH2-27 | tgggtnmgncargcnccnggnaarggnytngartgggtngcn | 992 |
| FRH2-28 | tgggtnmgncargcnccnggnaarggnytngartgggtngcn | 992 |
| FRH2-29 | tgggtnmgncargcnccnggnaarggnytngartgggtngcn | 992 |
| FRH2-30 | tgggtnmgncargcnccnggnaarggnytngartgggtngcn | 992 |
| FRH2-31 | tgggtnmgncargcnccnggnaarggnytngartgggtnwsn | 991 |
| FRH2-32 | tgggtnmgncargcnccnggnaarggnytngartgggtnwsn | 991 |
| FRH2-33 | tgggtnmgncargcnccnggnaarggnytngartgggtnwsn | 991 |
| FRH2-34 | tgggtnmgncargcnccnggnaarggnytngartgggtnwsn | 991 |
| FRH2-35 | tggathmgncarcayccnggnaarggnytngartggathggn | 993 |
| FRH2-36 | tggathmgncarcayccnggnaarggnytngartggathggn | 993 |
| FRH2-37 | tggathmgncarcayccnggnaarggnytngartggathggn | 993 |
| FRH2-38 | tggathmgncarcayccnggnaarggnytngartggathggn | 993 |
| FRH2-39 | tggathmgncarcayccnggnaarggnytngartggathggn | 993 |

FIGURE 21D

| NAME | SEQUENCE | SEQ ID NO: |
|---|---|---|
| FRH2-40 | tggathmgncarcayccnggnaarggnytngartggathggn | 993 |
| FRH2-41 | tggathmgncarcayccnggnaarggnytngartggathggn | 993 |
| FRH2-42 | tggathmgncarcayccnggnaarggnytngartggathggn | 993 |
| FRH2-43 | tggathmgncarcayccnggnaarggnytngartggathggn | 993 |
| FRH2-44 | tgggtnmgncarcayccnggnaarggnytngartggathggn | 994 |
| FRH2-45 | tgggtnmgncarcayccnggnaarggnytngartggathggn | 994 |
| FRH2-46 | tggathmgncarccnccnggnaarggnytngartggathggn | 995 |
| FRH2-47 | tggathmgncarccnccnggnaarggnytngartggathggn | 995 |
| FRH2-48 | tggathmgncarccnccnggnaarggnytngartggathggn | 995 |
| FRH2-49 | tggathmgncarccnccnggnaarggnytngartggathggn | 995 |
| FRH2-50 | tggathmgncarccnccnggnaarggnytngartggathggn | 995 |
| FRH2-51 | tggathmgncarccngcnggnaarggnytngartggathggn | 996 |
| FRH2-52 | tggathmgncarccnccnggnaarggnytngartggathggn | 995 |
| FRH2-53 | tggathmgncarccnccnggnaarggnytngartggathggn | 995 |
| FRH2-54 | tgggtnmgncaratgccnggnaarggnytngartggatgggn | 997 |
| FRH2-55 | tgggtnmgncaratgccnggnaarggnytngartggatgggn | 997 |
| FRH2-56 | tgggtnmgncaratgccnggnaarggnytngartggatgggn | 997 |
| FRH2-57 | tggathmgncarwsnccnwsnmgnggnytngartggytnggn | 998 |
| FRH2-58 | tgggtnmgncargcnccnggnaarggnytngartgggtnwsn | 991 |
| FRH3-1 | mgngtncanatgcancangaycanwsncanwsncangcntayat ggarytnmgnwsnytnmgnwsngaygaycangcngtntaytayt gygcnmgn | 999 |
| FRH3-2 | mgngtncanatgcancangaycanwsncanwsncangcntayat ggarytnmgnwsnytnmgnwsngaygaycangcngtntaytayt gygcnmgn | 999 |
| FRH3-3 | mgngtncanatgcanmgngaycanwsnathwsncangcntayat ggarytnwsnmgnytnmgnwsngaygaycangcngtntaytayt gygcnmgn | 1000 |
| FRH3-4 | mgngtncanatgcanmgngaycanwsnathwsncangcntayat ggarytnwsnmgnytnmgnwsngaygaycangcngtntaytayt gygcnmgn | 1000 |
| FRH3-5 | mgngtncanatgytngargaycanwsncangaycangcntayat ggarytnwsnwsnytnmgnwsngargaycangcngtntaytayt gygcncan | 1001 |

FIGURE 21E

| NAME | SEQUENCE | SEQ ID NO: |
|---|---|---|
| FRH3-6 | mgngtncanatgytngargaycanwsncangaycangcntayatggarytnwsnwsnytnmgnwsngargaycangcngtntaytaytgygcncan | 1001 |
| FRH3-7 | mgnytncanathwsnaargaycanwsnaarwsncargtngtnytncanatgcanaayatggayccngtngaycangcncantaytaytgygcnmgn | 1002 |
| FRH3-8 | mgnytncanathwsnaargaycanwsnaarwsncargtngtnytncanatgcanaayatggayccngtngaycangcncantaytaytgygcnmgn | 1002 |
| FRH3-9 | mgnytncanathcanaargaycanwsnaaraaycargtngtnytncanatgcanaayatggayccngtngaycangcncantaytaytgygcncay | 1003 |
| FRH3-10 | mgnytncanathcanaargaycanwsnaarcancargtngtnytncangtncangayatggayccngtngaycangcncantaytaytgygcncay | 1004 |
| FRH3-11 | mgnytncanathcanaargaycanwsnaaraaycargtngtnytncanatgcanaayatggayccngtngaycangcncantaytaytgygcncay | 1003 |
| FRH3-12 | mgnytncanathcanaargaycanwsnaaraaycargtngtnytncanatgcanaayytngayccngtngaycangcncantaytaytgygcncay | 1005 |
| FRH3-13 | mgnytncanathcanaargcncanwsnaaraaycargtngtnytncanatgcanaayatggayccngtngaycangcncantaytaytgygcncay | 1006 |
| FRH3-14 | mgnytncanathcanaargaycanwsnaaraaycargtngtnytncanatgcanaayatggayccngtngaycangcncantaytaytgygcncay | 1003 |
| FRH3-15 | mgnytncanathcanaargaycanwsnaaraaycargtngtnytncanatgcanaayatggayccngtngaycangcncantaytaytgygcncay | 1003 |
| FRH3-16 | mgnttycanathwsnmgngayaaygcnaaraaywsnytntayytncaratgaaywsnytnmgngcngargaycangcngtntaytaytgygcnmgn | 1007 |
| FRH3-17 | mgnttycanathwsnmgngayaaywsnaaraaycanytntayytncaratgaaywsnytnmgngcngargaycangcngtntaytaytgygcnaar | 1008 |

FIGURE 21F

| NAME | SEQUENCE | SEQ ID NO: |
|---|---|---|
| FRH3-18 | mgnttycanathwsnmgngayaaywsnaaraaycanytntayyt ncaratgaaywsnytnmgngcngargaycangcngtntaytayt gygcnaar | 1008 |
| FRH3-19 | mgnttycanathwsnmgngayaaywsnaaraaycanytntayyt ncaratgaaywsnytnmgngcngargaycangcngartaytayt gygcnaar | 1009 |
| FRH3-20 | mgnttycanathwsnmgngayaaywsnaaraaycanytntayyt ncaratgaaywsnytnmgngcngargaycangcngartaytayt gygcnaar | 1009 |
| FRH3-21 | mgnttycanathwsnmgngayaaywsnatgaaycanytntayyt ncaratgaaywsnytnmgngcngargaycangcngtntaytayt gygcnmgn | 1010 |
| FRH3-22 | mgnttycanathwsnmgngayaaywsnatgaaycanytntayyt ncaratgaaywsnytnmgngcngargaycangcngtntaytayt gygcnmgn | 1010 |
| FRH3-23 | mgnttycanathwsnmgngayaaywsnaaraaycanytntayyt ncaratgaaywsnytnmgngcngargaycangcngtntaytayt gygcnmgn | 1011 |
| FRH3-24 | mgnttycanathwsnmgngayaaywsnaaraaycanytntayyt ncaratgaaywsnytnmgngcngargaycangcngtntaytayt gygcnmgn | 1011 |
| FRH3-25 | mgnttycanathwsnmgngayaaywsnaaraaycanytntayyt ncaratgaaywsnytnmgngcngargaycangcngtntaytayt gygcnmgn | 1011 |
| FRH3-26 | mgnttycanathwsnmgngayaaywsnaaraaycanytntayyt ncaratgaaywsnytnmgngcngargaycangcngtntaytayt gygtnytn | 1012 |
| FRH3-27 | mgnttycanathwsnmgngayaaywsnaaraaycanytntayyt ncaratgaaywsnytnmgngcngargaycangcngtntaytayt gygcnmgn | 1011 |
| FRH3-28 | mgnttycangtnwsnmgngayaaywsnaaraaycanytnttyyt ncaratgaaywsnytnmgngcngargaycangcngtntaytayt gygcnmgn | 1013 |
| FRH3-29 | mgnttycanathwsnmgngayaaywsnaaraaycanytntayyt ncaratgaaywsnytnmgngcngargaycangcngtntaytayt gygcnmgn | 1011 |

FIGURE 21G

| NAME | SEQUENCE | SEQ ID NO: |
|---|---|---|
| FRH3-30 | mgnttycanathwsnmgngayaaywsnaaraaycanytngayyt ncaratgaaywsnytnmgngcngargaycangcngtntaytayt gygcnmgn | 1013 |
| FRH3-31 | mgnttycanathwsnmgngayaaygcnaaraaywsnytnttyyt ncaratgaaywsnytnmgngaygargaycangcngtntaytayt gygcnytn | 1014 |
| FRH3-32 | mgnttycanathwsnmgngayaaygcnaaraaywsngtntayyt ncaratgaaywsnytnmgngaygargaycangcngtntaytayt gygcnmgn | 1015 |
| FRH3-33 | mgnttycanathwsnmgngayaaygcnaaraaywsnytntayyt ncaratgaaywsnytnmgngaygargaycangcngtntaytayt gygcnmgn | 1016 |
| FRH3-34 | mgnttycanathwsnmgngayaaygcnaaraaywsnytntayyt ncaratgaaywsnytnmgngaygargaycangcngtntaytayt gygcnmgn | 1016 |
| FRH3-35 | mgngtncanathwsngtngaycanwsnaaraaycarttywsnyt naayytnwsnwsngtncangcngcngaycangcngtntaytayt gygcnmgn | 1017 |
| FRH3-36 | mgngtnaayatgwsngtngaycanwsnaaraaycarttywsnyt naarytnwsnwsngtncangcngcngaycangcngtntaytayt gygcnmgn | 1018 |
| FRH3-37 | mgngtnaayatgwsngtngaycanwsnaaraaycarttywsnyt naarytnwsnwsngtncangcngcngaycangcngtntaytayt gygcnmgn | 1018 |
| FRH3-38 | mgngtncanathwsngtngaycanwsnaaraaycarttywsnyt naarytnwsnwsngtncangcngcngaycangcngtntaytayt gygcnmgn | 1019 |
| FRH3-39 | mgnathcanathwsngcngaycanwsnaaraaycarttywsnyt naarytnaaywsngtncangcngcngaycangcngtntaytayt gygcnmgn | 1020 |
| FRH3-40 | mgnathcanathwsngcngaycanwsnaaraaycarttywsnyt naarytnaaywsngtncangcngcngaycangcngtntaytayt gygcnmgn | 1020 |
| FRH3-41 | mgnathcanaarwsngtngaycanwsnaaraaycarttywsnyt naarytnwsnwsngtncangcngcngaycangcngtntaytayt gygcnmgn | 1021 |

FIGURE 21H

| NAME | SEQUENCE | SEQ ID NO: |
|---|---|---|
| FRH3-42 | mgnathcanaarwsngtngaycanwsnaaraaycarttywsnyt naarytnwsnwsngtncangcngcngaycangcngtntaytayt gygcnmgn | 1021 |
| FRH3-43 | mgngtncanathwsngtngaycanwsnaaraaycarttywsnyt naarytnwsnwsngtncangcngcngaycangcngtntaytayt gygcnwsn | 1022 |
| FRH3-44 | mgngtncanathwsngtngaycanwsnaaraaycarttywsnyt naarytnttywsngtncangcngcngaycangcngtntayttyt gygcnmgn | 1023 |
| FRH3-45 | mgngtncanathwsngtngaycanwsnaaraaycarttywsnyt naarytnttywsngtncangcngcngaycangcngtntayttyt gygcnmgn | 1023 |
| FRH3-46 | mgngtncanathwsngtngaycanwsnaaraaycarttywsnyt naarytnwsnwsngtncangcngcngaycangcngtntaytayt gygcnmgn | 1019 |
| FRH3-47 | mgngtncanathwsngtngaycanwsnaaraaycarttywsnyt naarytnwsnwsngtncangcngcngaycangcngtntaytayt gygcnmgn | 1019 |
| FRH3-48 | mgngtncanathwsngtngaycanwsnaaraaycarttywsnyt naarytnwsnwsngtncangcngcngaycangcngtntaytayt gygcnmgn | 1019 |
| FRH3-49 | mgngtncanathwsngtngaycanwsnaaraaycarttywsnyt naarytnwsnwsngtncangcngcngaycangcngtntaytayt gygcnmgn | 1019 |
| FRH3-50 | mgngtncanathwsngtngaycanwsnaaraaycarttywsnyt naarytnwsnwsngtncangcngcngaycangcngtntaytayt gygcnmgn | 1019 |
| FRH3-51 | mgngtncanatgwsngtngaycanwsnaaraaycarttywsnyt naarytnwsnwsngtncangcngcngaycangcngtntaytayt gygcnmgn | 1024 |
| FRH3-52 | mgngtncanathwsnathgtncanwsnmgnaaycarttywsnyt naarytnwsnwsngtncangcngcngaycangcngtntaytayt gygcnmgn | 1025 |
| FRH3-53 | mgngtncanathwsnathgtncanwsnmgnaaycarttywsnyt naarytnwsnwsngtncangcngcngaycangcngtntaytayt gygcnmgn | 1025 |

FIGURE 21I

| NAME | SEQUENCE | SEQ ID NO: |
|---|---|---|
| FRH3-54 | cargtncanathwsngcngayaarwsnathwsncangcntayyt ncartggwsnwsnytnaargcnwsngaycangcnatgtaytayt gygcnmgn | 1026 |
| FRH3-55 | cargtncanathwsngcngayaarwsnathaaycangcntayyt ncartggwsnwsnytnaargcnwsngaycangcnatgtaytayt gygcnmgn | 1027 |
| FRH3-56 | cargtncanathwsngcngayaarwsnathwsncangcntayyt ncartggwsnwsnytnaargcnwsngaycangcnatgtaytayt gygcnmgn | 1026 |
| FRH3-57 | mgnathcanathaayccngaycanwsnaaraaycarttywsnyt ncarytnaaywsngtncanccngargaycangcngtntaytayt gygcnmgn | 1028 |
| FRH3-58 | mgnttycanathwsnmgngayaaygcnaaraaywsnytnttyyt ncaratgaaywsnytnmgngaygargaycangcngtntaytayt gygcnytn | 1014 |
| FRH4-1 | tggggncarggncanytngtncangtnwsnwsn | 1029 |
| FRH4-2 | tggggncarggncanytngtncangtnwsnwsn | 1029 |
| FRH4-3 | tggggncarggncanytngtncangtnwsnwsn | 1029 |
| FRH4-4 | tggggncarggncanytngtncangtnwsnwsn | 1029 |
| FRH4-5 | tggggncarggncancangtncangtnwsnwsn | 1030 |
| FRH4-6 | tggggncarggncancangtncangtnwsnwsn | 1030 |
| FRH4-7 | tggggncarggncanytngtncangtnwsnwsn | 1029 |
| FRH4-8 | tggggncarggncancangtncangtnwsnwsn | 1030 |
| FRH4-9 | tggggncarggncanytngtncangtnwsnwsn | 1029 |
| FRH4-10 | tggggncarggncanytngtncangtnwsnwsn | 1029 |
| FRH4-11 | tggggncarggncanytngtncangtnwsnwsn | 1029 |
| FRH4-12 | tggggncarggncanytngtncangtnwsnwsn | 1029 |
| FRH4-13 | tggggncarggncanytngtncangtnwsnwsn | 1029 |
| FRH4-14 | tggggncarggncanytngtncangtnwsnwsn | 1029 |
| FRH4-15 | tggggncarggncanytngtncangtnwsnwsn | 1029 |
| FRH4-16 | tggggncarggncanatggtncangtnwsnwsn | 1031 |
| FRH4-17 | tggggncarggncancangtncangtnwsnwsn | 1030 |
| FRH4-18 | tggggncarggncancangtncangtnwsnwsn | 1030 |
| FRH4-19 | tggggncarggncancangtncangtnwsnwsn | 1030 |
| FRH4-20 | tggggncarggncancangtncangtnwsnwsn | 1030 |
| FRH4-21 | tggggncarggncanytngtncangtnwsnwsn | 1029 |
| FRH4-22 | tggggncarggncanytngtncangtnwsnwsn | 1029 |
| FRH4-23 | tggggncarggncanytngtncangtnwsnwsn | 1029 |
| FRH4-24 | tggggncarggncanytngtncangtnwsnwsn | 1029 |

FIGURE 21J

| NAME | SEQUENCE | SEQ ID NO: |
|---|---|---|
| FRH4-25 | tggggncarggncanytngtncangtnwsnwsn | 1029 |
| FRH4-26 | tggggncarggnwsnytngtncangtnwsnccn | 1032 |
| FRH4-27 | tggggncarggncanytngtncangtnwsnwsn | 1029 |
| FRH4-28 | tggggncarggncancangtncangtnwsnwsn | 1030 |
| FRH4-29 | tggggncarggncanytngtncangtnwsnwsn | 1029 |
| FRH4-30 | tggggncarggncanytngtncangtnwsnwsn | 1029 |
| FRH4-31 | tggggncarggncanytngtncangtnwsnwsn | 1029 |
| FRH4-32 | tggggncarggncancangtncangtnwsnwsn | 1030 |
| FRH4-33 | tggggncarggncancangtncangtnwsnwsn | 1030 |
| FRH4-34 | tggggncarggncancangtncangtnwsnwsn | 1030 |
| FRH4-35 | tggggncarggncancangtncangtnwsnwsn | 1030 |
| FRH4-36 | tggggncarggncanaargtncangtnwsnwsn | 1033 |
| FRH4-37 | tggggncarggncanaargtncangtnwsnwsn | 1033 |
| FRH4-38 | tggggncarggncancangtncangtnwsnwsn | 1030 |
| FRH4-39 | tggggncarggncancangtncangtnwsnwsn | 1030 |
| FRH4-40 | tggggncarggncancangtncangtnwsnwsn | 1030 |
| FRH4-41 | tggggnmgnggncanytngtncangtnwsnwsn | 1034 |
| FRH4-42 | tggggnmgnggncanytngtncangtnwsnwsn | 1034 |
| FRH4-43 | tggggncarggncancangtncangtnwsnwsn | 1030 |
| FRH4-44 | tggggncarggncanytngtncangtnwsnwsn | 1029 |
| FRH4-45 | tggggncarggncanytngtncangtnwsnwsn | 1029 |
| FRH4-46 | tggggncarggncanytngtncangtnwsnwsn | 1029 |
| FRH4-47 | tggggncarggncanytngtncangtnwsnwsn | 1029 |
| FRH4-48 | tggggncarggncanytngtncangtnwsnwsn | 1029 |
| FRH4-49 | tggggncarggncanytngtncangtnwsnwsn | 1029 |
| FRH4-50 | tggggncarggncanytngtncangtnwsnwsn | 1029 |
| FRH4-51 | tggggncarggncancangtncangtnwsnwsn | 1030 |
| FRH4-52 | tggggncarggncanatggtncangtnwsnwsn | 1031 |
| FRH4-53 | tggggncarggncanatggtncangtnwsnwsn | 1031 |
| FRH4-54 | tggggncarggncanytngtncangtnwsnwsn | 1029 |
| FRH4-55 | tggggncarggncanytngtncangtnwsnwsn | 1029 |
| FRH4-56 | tggggncarggncancangtncangtnwsnwsn | 1030 |
| FRH4-57 | tggggncarggncancangtncangtnwsnwsn | 1030 |
| FRH4-58 | tggggncarggncanytngtncangtnwsnwsn | 1029 |

FIGURE 21K

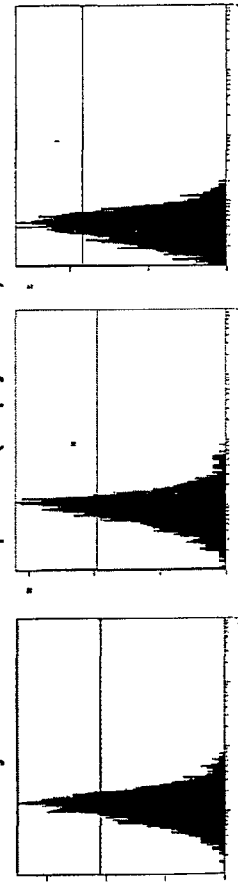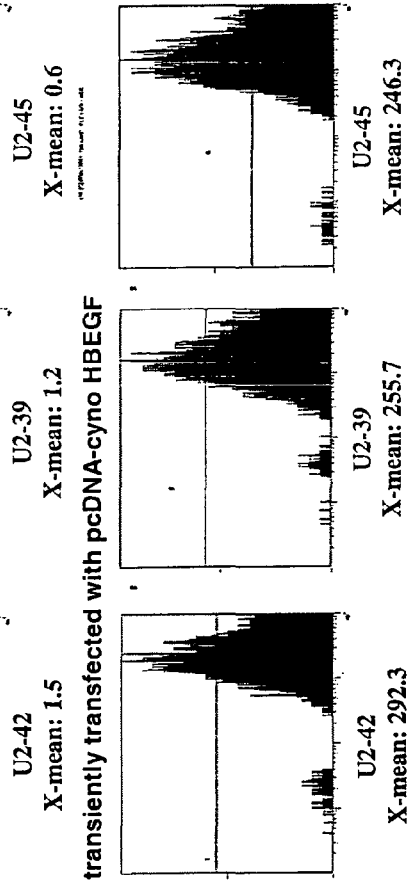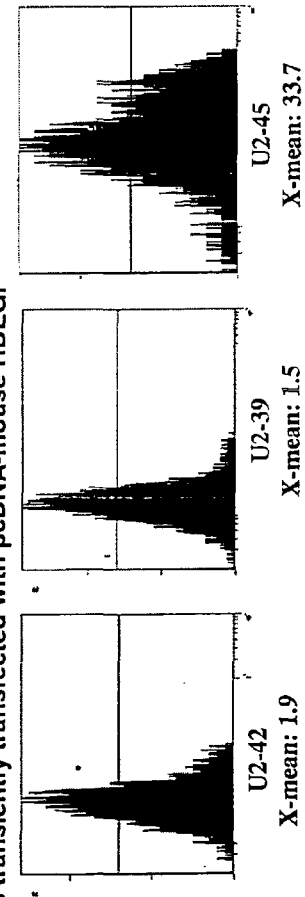
Fig 30 A
Fig 30 B

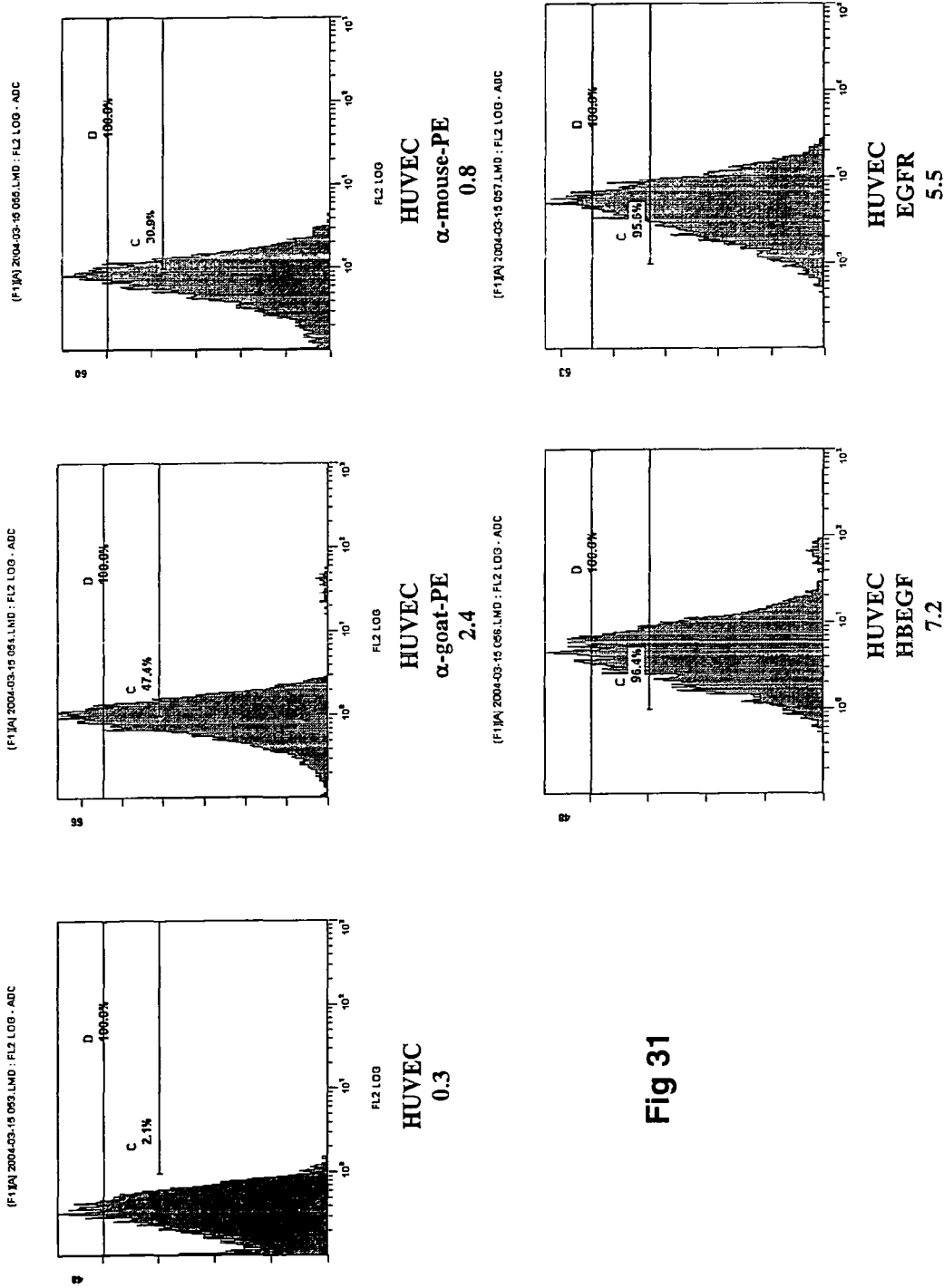

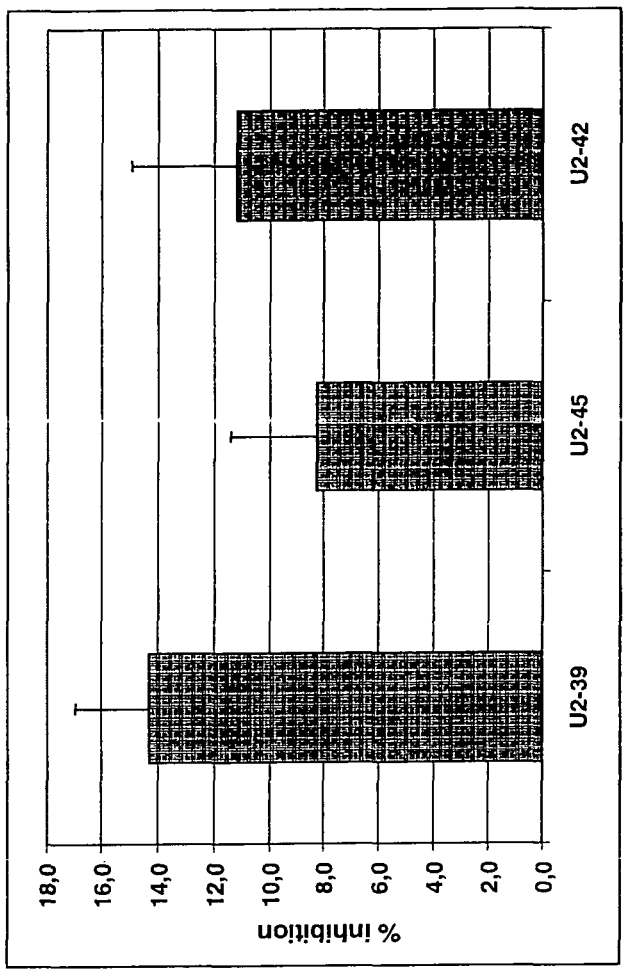
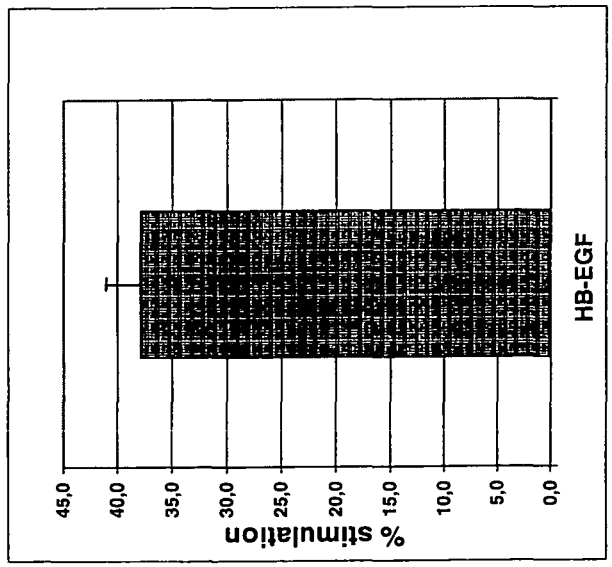
Fig 32 A / Fig 32 B — Effect of HBEGF and HBEGF antibodies on HUVEC proliferation Figs 33 A-M
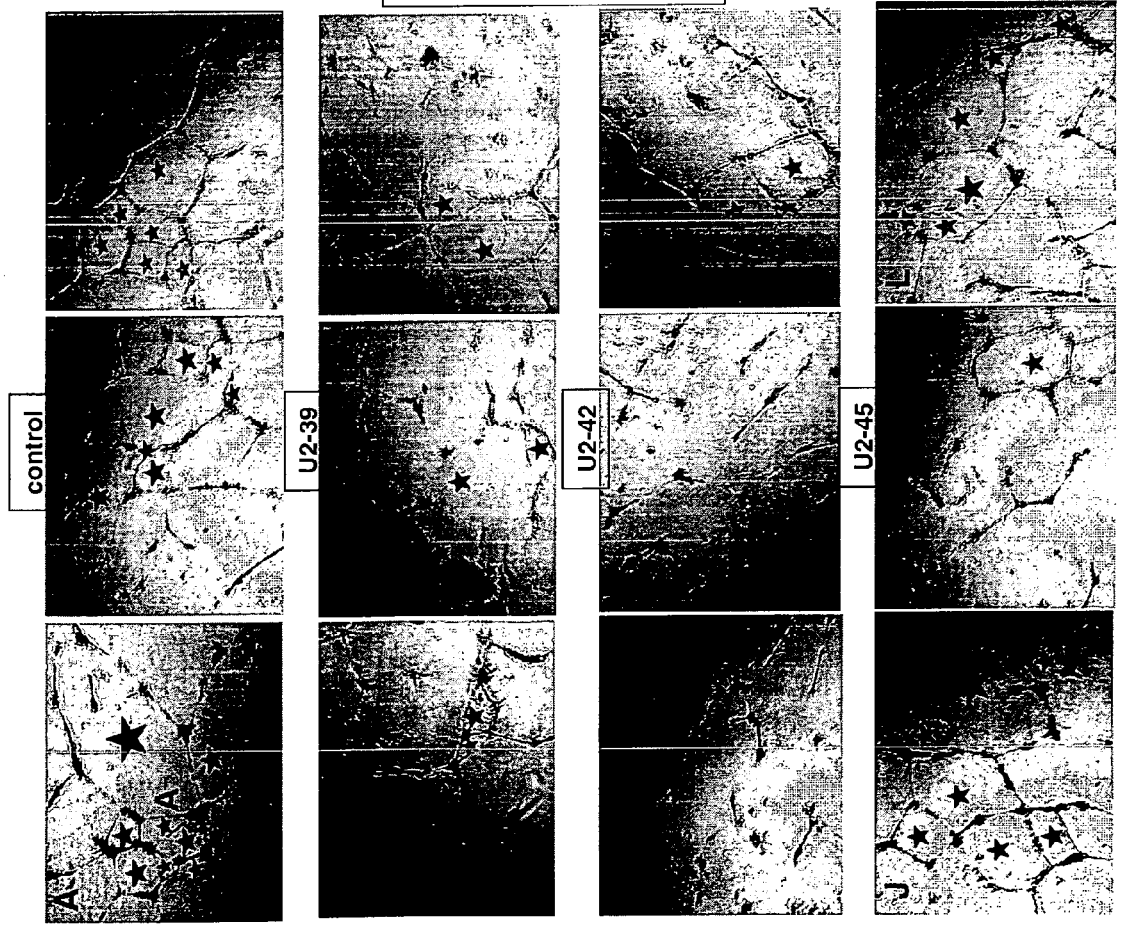

Soft agar – Inhibition of HBEGF stimulated colony formation
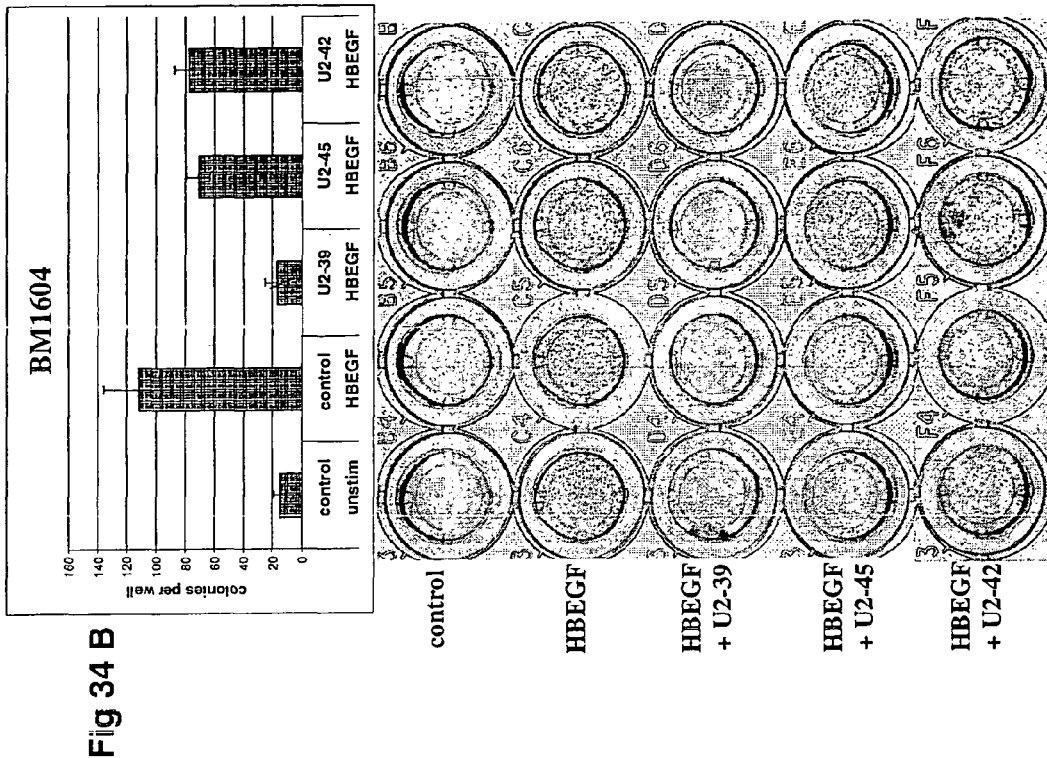
Fig 34 B
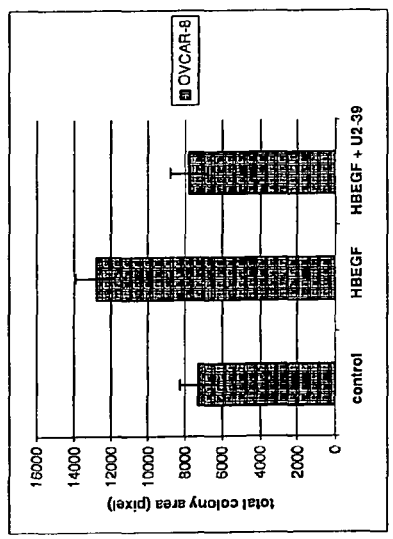
Fig 34 A
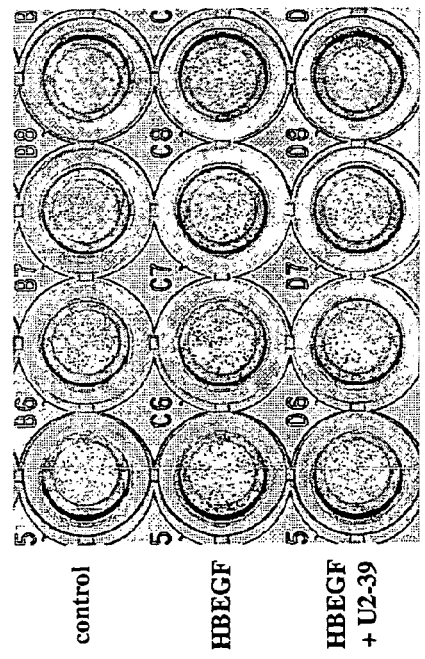

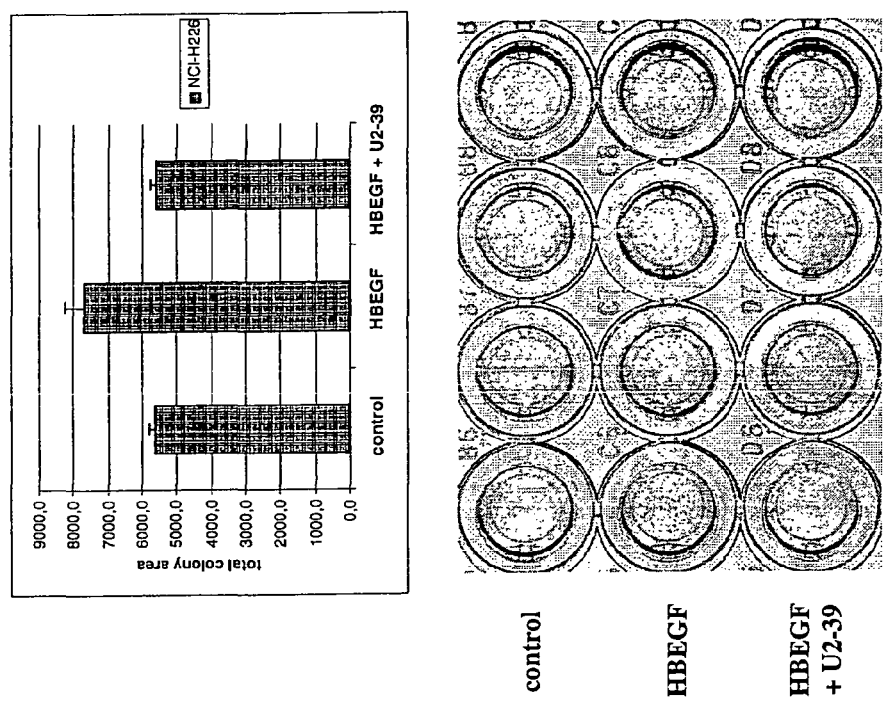
Fig 34 C  Soft agar – Inhibition of HBEGF stimulated colony formation

SkOV-3 HBEGF clones - Inhibition of basal colony formation
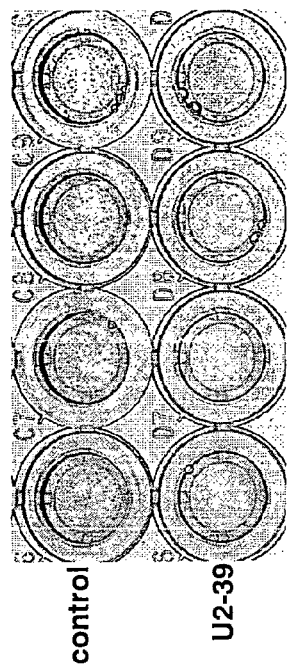
Fig 34 E
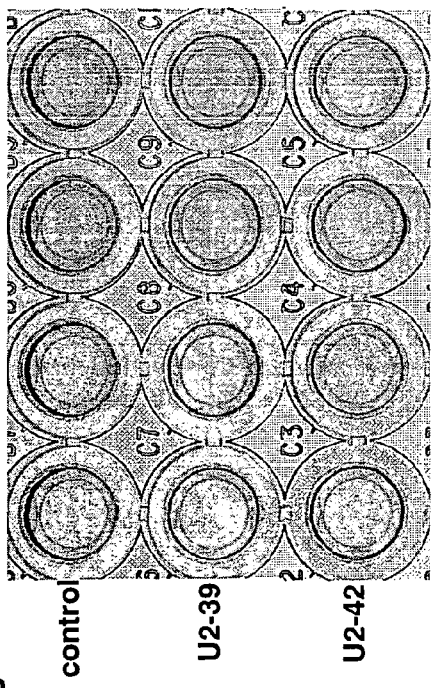
Fig 34 D
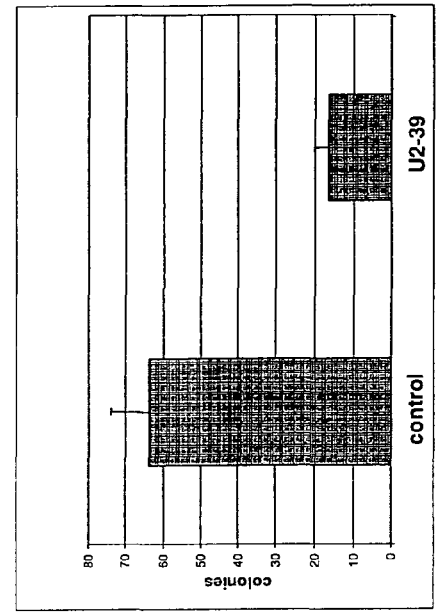
SkOV-3 clone 74
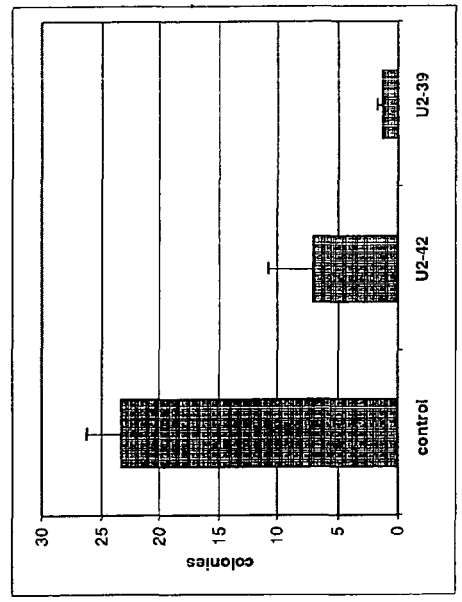
SkOV-3 clone 71

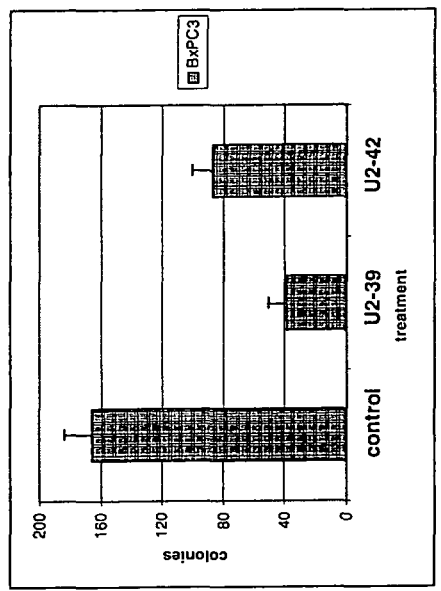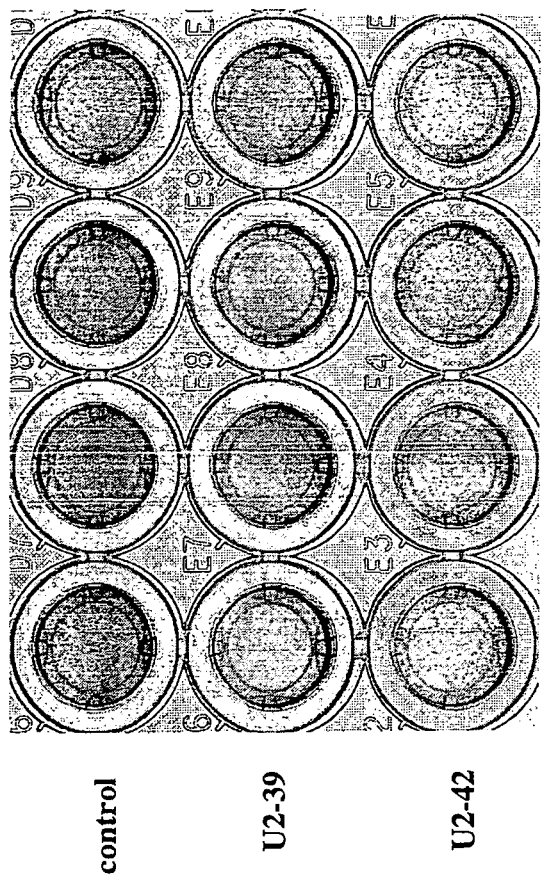
Fig 34 F

Fig 36. *In vivo* anti-angiogenic properties of anti-HB-EGF antibodies in the mouse matrigel plug assay

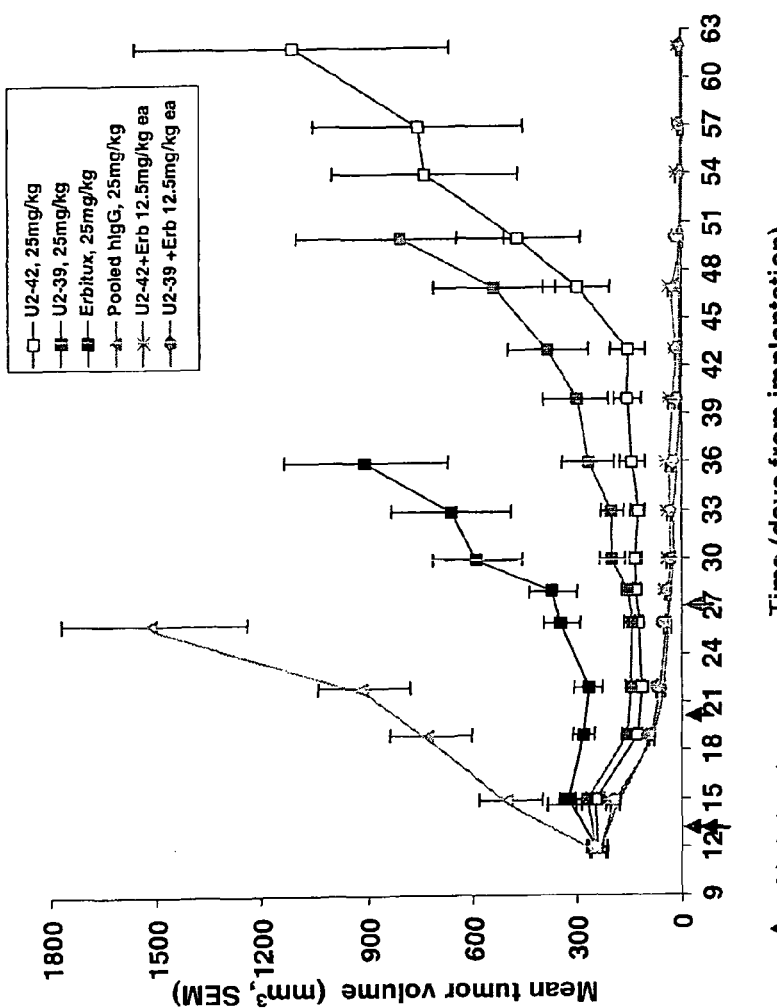
Fig 38C Anti-HB-EGF antibodies synergize in combination with anti-EGFR therapy in the treatment of ovarian cancer tumor growth *in vivo*

Immunohistochemistry of human tissue with human anti HB-EGF antibodies

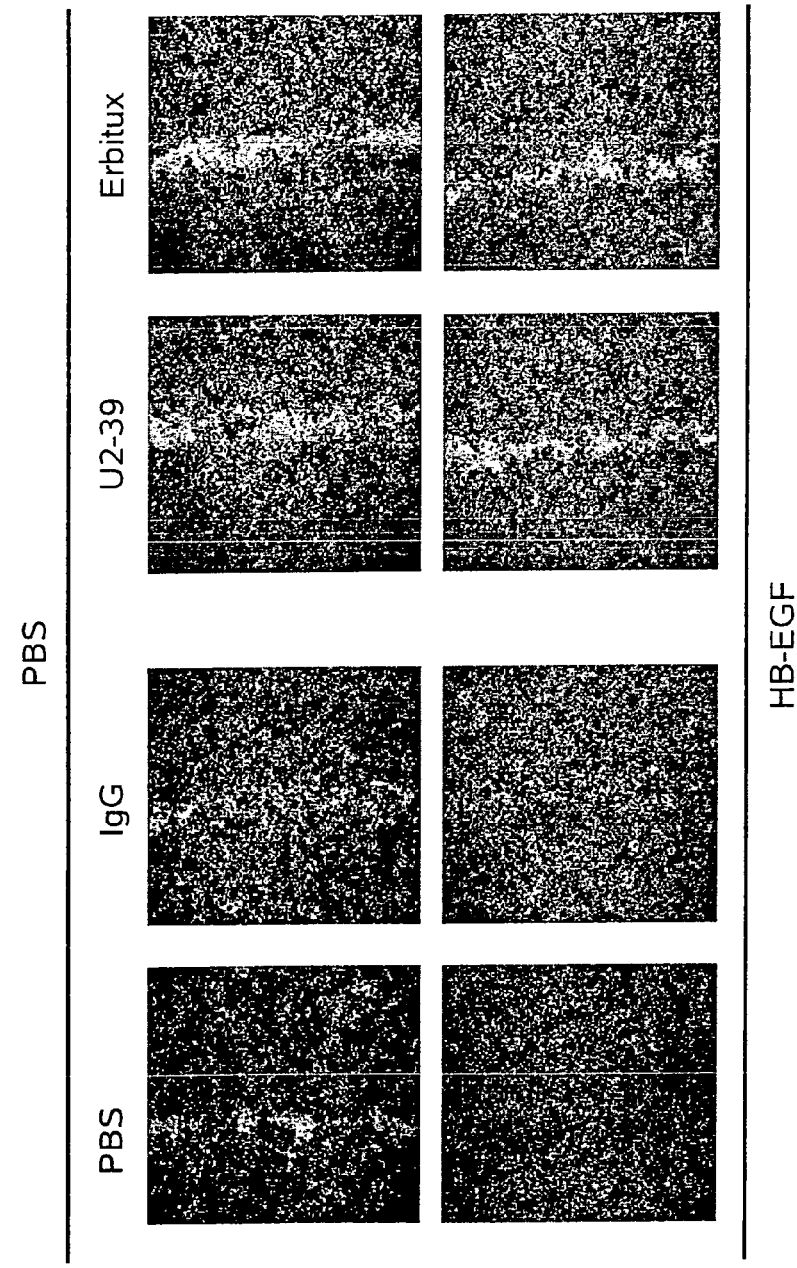

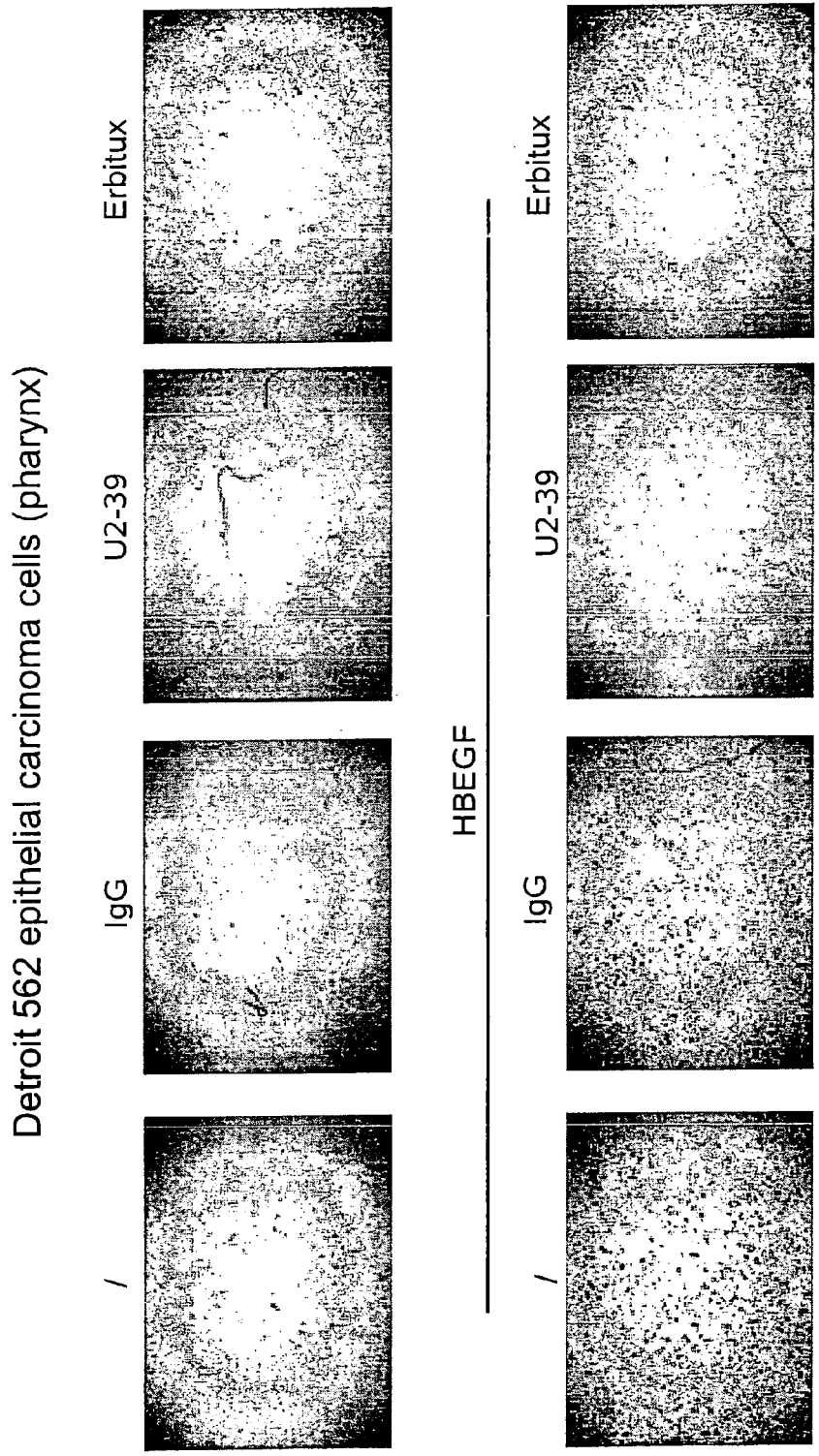
Fig 40B Transmigration assay - Inhibition of HB-EGF-induced migration

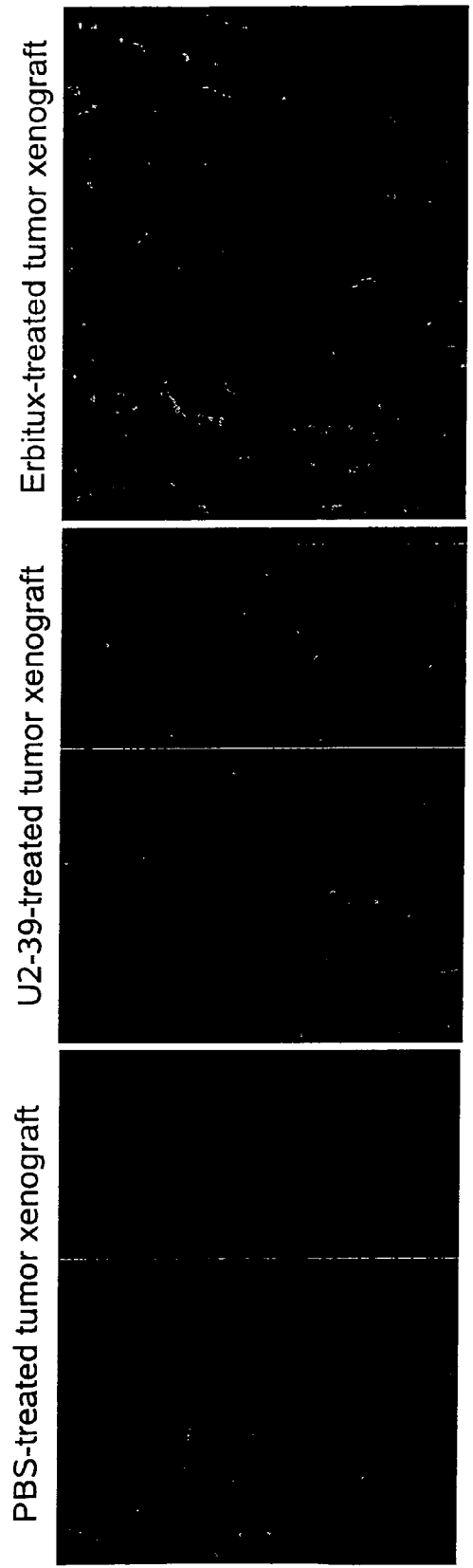
Fig 42 IHC analysis of tumor xenograft samples- Inhibition of CD31 staining of human tumor xenografts *in vivo*

In vivo ovarian tumor xenograft model-
Combination treatment of U2-39 with Cisplatin Subcutaneous EFO-27-HB-EGF ovarian cancer xenograft model In vivo ovarian tumor xenograft model-
Combination treatment of U2-39 with Avastin Subcutaneous EFO-27-HB-EGF ovarian cancer xenograft model

HEPARIN-BINDING EPIDERMAL GROWTH FACTOR-LIKE GROWTH FACTOR BINDING PROTEINS

A sequence listing is provided herewith on two computer-readable CDs (i.e., Copy 1 and Copy 2) and is incorporated herein by reference in its entirety. Copy 1 and Copy 2 contain identical information, including sequence files SEQ ID NOS: 1-1116 with 1,681,839 bytes. Both CDs were created on Oct. 29, 2010.

BACKGROUND

The human epidermal growth factor receptor (HER) family comprises four distinct receptor tyrosine kinases referred to as HER1 (or erbB1), HER2 (or erbB2), HER3 (or erbB3), and HER4 (or erbB4). HER1 is also commonly referred to as epidermal growth factor receptor (EGFR). With the exception of HER3, these receptors have phospho-acceptor target specific intrinsic protein tyrosine kinase activities. Members of the HER family are expressed in most epithelial cells as well as in a number of different tumor cell types. For example, receptors of the HER family are expressed in tumor cells of epithelial origin, and of mesenchymal origin. Moreover, HER receptor tyrosine kinases are involved in cell proliferation and angiogenesis, which are associated with diseases such as cancer. For example, EGFR is frequently over-expressed or aberrantly activated in breast cancers, liver cancers, kidney cancers, leukemia, bronchial cancers, pancreatic cancers and gastrointestinal cancers such as colon, rectal or stomach cancers. High levels of the EGF receptor also correlate with poor prognosis and response to treatment (Wright et al., 1992, *Br. J. Cancer* 65:118-121). Thus, disruption of signal transduction from and to these kinases would have an anti-proliferative, and as such, therapeutic effect upon a number of cancer and tumor cell types.

The enzymatic activity of receptor tyrosine kinases can be stimulated by over-expression and/or by ligand-mediated dimerization (Heldin, 1995, *Cell* 80:213-223). Activation of receptor homodimers and heterodimers results in phosphorylation of tyrosine residues on the receptors, which in turn phosphorylate tyrosine residues of other molecules, including intracellular proteins. (Ullrich et al., 1990, *Cell* 61:203-212). This is followed by the activation of intracellular signaling pathways such as those involving the mitogen-activated protein kinase (MAP kinase) (Dhillon et al., 2007, *Oncogene* 26: 3279-3290) and the phosphatidylinositol 3-kinase (PI3 kinase). While activation of these pathways has been shown to increase cell proliferation and inhibit apoptosis, inhibition of signaling mediated by HER family members by either small molecule inhibitors or monoclonal antibodies has been shown to inhibit cell proliferation and promote apoptosis (Prenzel et al., 2001, *Endocr. Relat. Cancer* 8: 11-31)

Heparin-binding epidermal growth factor-like growth factor (HB-EGF) is a 22 kDa, O-glycosylated protein (Higahiyama et al., 1992, *J Biol Chem* 267: 6205-6212). In its mature form, HB-EGF binds to and activates the EGF receptor and HER4 (Elenius et al., 1997, *EMBO* 16:1268-1278). HB-EGF is the key mediator of G-protein coupled receptor (GPCR) induced cell proliferation via a process called triple-membrane passing signaling (IMPS) (Prenzel et al., 1999, *Nature* 402:884-888, review in Fischer et al. 2003, *Biochem. Soc. Trans.* 31:1203-1208). It has been shown that HB-EGF promotes cellular proliferation as well as angiogenesis (Zushi et al., 1997, *Int J Cancer* 73:917-923; Abramovitch et al., 1998, *FEBS letters* 425:441-447). HB-EGF also has been demonstrated to play a key role in a number of cancers, i.e., it has been linked to the aggressive behavior of ovarian tumors (Tanaka at al., 2005, *Clin. Cancer Res.* 11:4783-4792). Moreover, HB-EGF is essential for xenograft tumor formation by ovarian cancer cell lines. Over-expression of HB-EGF (wild type or a secreted form) accelerates tumor formation in SKOV3 and RMG-1 cells. Knockdown of endogenous HB-EGF using siRNA, yet, abolished or delayed tumor formation by SKOV3 and RMG-1 cells. Miyamoto, 2004, *Cancer Res.* 64:5720. As suggested by the above evidence, inhibition of HB-EGF expression or activity may inhibit tumor formation.

Similarly, HB-EGF is a marker of poor prognosis in some cancers, including human bladder cancers (Thogersen et al., 2001, *Cancer Res.* 61:6227-6233). In vitro studies indicate that human EJ bladder cells that were engineered to express HB-EGF (wild type, soluble or non-cleavable) exhibit an increase in growth, anchorage independent growth, and production of VEGF, and enhanced migration. When these HB-EGF-expressing EJ bladder cells were transplanted into nude mice, an increase in tumor formation, size and density of blood vessels was observed in those tumors. (Ongusaha, 2004, *Cancer Res.* 64:5283-5290).

SUMMARY

Provided herein are isolated antigen binding proteins that bind HB-EGF. Some of these antigen binding proteins comprise A) one or more light chain complementary determining regions (CDRLs) consisting of: (i) a CDRL1 selected from SEQ ID NOs:189-217; (ii) a CDRL2 selected from SEQ ID NOs:218-233; (iii) a CDRL3 selected from SEQ ID NO:234-274; or (iv) a CDRL of (i), (ii) or (iii) that contains one or more amino acid substitutions, deletions or insertions of no more than four amino acids. Alternatively, the HB-EGF antigen binding protein may comprise B) one or more heavy chain complementary determining regions (CDRHs) consisting of: (i) a CDRH1 selected from SEQ ID NO:275-299; (ii) a CDRH2 selected from SEQ ID NO:300-331; (iii) a CDRH3 selected from SEQ ID NO:332-372; or (iv) a CDRH of (i), (ii) or (iii) that contains one or more amino acid substitutions, deletions or insertions of no more than four amino acids.

In one embodiment, the isolated antigen binding protein may comprise one, two or more of the aforementioned light chain CDRLs and one, two or more of the aforementioned heavy chain CDRHs. In one aspect, the isolated antigen binding protein comprises CDRH1, CDRH2, CDRH3, CDRL1, CDRL2 and CDRL3. In another aspect, the isolated antigen binding protein of A), supra, is selected from the group consisting of: a CDRL1 from SEQ ID NOs:189-217; a CDRL2 from SEQ ID NOs:218-233; a CDRL3 from SEQ ID NOs: 234-274; and a CDRL of the any of the aforementioned (i), (ii) or (ii) that contains one or more amino acid substitutions, deletions or insertions of no more than two amino acids. In addition, said heavy chain CDRH of B), supra, is selected from a CDRH1 from SEQ ID NOs:275-299; a CDRH2 from SEQ ID NOs:300-331; a CDRH3 amino acid sequence from SEQ ID NOs:332-372 and a CDRH of the aforementioned that contains one or more amino acid substitutions, deletions or insertions of no more than two amino acids. Furthermore, the isolated antigen binding protein may comprise or one or more light chain CDRLs of A), supra; and one or more heavy chain CDRHs of B), supra.

In another embodiment, the antigen binding protein comprises a CDRL selected from the following: a CDRL1 from SEQ ID NOs:189-217; a CDRL2 from SEQ ID NOs:218-233; and a CDRL3 from SEQ ID NOs:234-274. The antigen binding protein may also comprise a CDRH selected from one of the following: a CDRH1 from SEQ ID NOs:275-299; a CDRH2 from SEQ ID NOs:300-331; and a CDRH3 selected from SEQ ID NOs:332-372. Alternatively, the isolated antigen binding protein may comprise one or more light chain CDRLs listed in A), supra, and one or more heavy chain CDRHs of B), supra. In particular, the isolated antigen binding protein may comprise a CDRL1 of SEQ ID NOs:189-217, a CDRL2 of SEQ ID NOs:218-233, and a CDRL3 of SEQ ID NOs:234-274 and/or a CDRH1 of SEQ ID NOs:275-299, a CDRH2 of SEQ ID NOs:300-331, and a CDRH3 of SEQ ID NO:332-372.

In one aspect, the isolated antigen binding protein comprises a light chain variable region ($V_L$) having at least 80%, 90% or 100% sequence identity with an amino acid sequence selected from SEQ ID NOs:94-141. In another aspect, the isolated antigen binding protein comprises a heavy chain variable region ($V_H$) having at least 80%, 90% or 100% sequence identity with an amino acid sequence from SEQ ID NOs:142-186.

In another embodiment, the isolated antigen binding protein specifically recognizes at least an IHGE containing epitope and/or an EGF-like domain of HB-EGF.

Provided herein, in addition, is an isolated antigen binding protein that competes for binding with the isolated antigen binding protein that binds HB-EGF, as described above.

Also provided herein is an isolated antigen binding protein which binds HB-EGF and comprises A) one or more light chain CDRs (CDRLs) from the group consisting of: (i) a CDRL1 with at least 80%, or at least 90% sequence identity to SEQ ID NOs:189-217; (ii) a CDRL2 with at least 80%, or at least 90% sequence identity to SEQ ID NOs:218-233; and (iii) a CDRL3 with at least 80%, or at least 90% sequence identity to SEQ ID NOs:234-274. Alternatively, the isolated antigen binding protein which binds HB-EGF, comprises B) one or more heavy chain CDRs (CDRHs) from the group consisting of (i) a CDRH1 with at least 80%, or at least 90% sequence identity to SEQ ID NOs:275-299; (ii) a CDRH2 with at least 80%, or at least 90% sequence identity to SEQ ID NOs:300-331; and (iii) a CDRH3 with at least 80%, or at least 90% sequence identity to SEQ ID NOs:332-372. The isolated antigen binding protein may also comprise C) one or more light chain CDRLs of A) and one or more heavy chain CDRHs of B).

In another embodiment, the isolated antigen binding protein binds HB-EGF and comprises: A) a light chain complementary determining region (CDRL) selected from: (i) a CDRL3 selected from the group consisting of SEQ ID NOs: 234-274; (ii) a CDRL3 that differs in amino acid sequence from the CDRL3 of (i) by an amino acid addition, deletion or substitution of not more than two amino acids; and (iii) a CDRL3 amino acid sequence selected from the following:

$X_1QX_2X_3X_4X_5PX_6X_7$ (SEQ ID NO:1046), wherein
$X_1$ is I or M,
$X_2$ is A, G or S,
$X_3$ is I or T,
$X_4$ is H or Q,
$X_5$ is F, L or W,
$X_6$ is C, I, H, L or T,
$X_7$ is S or T;
$QQX_1X_2X_3X_4X_5IT$ (SEQ ID NO:1047), wherein
$X_1$ is I or S,
$X_2$ is F or Y,
$X_3$ is F, I, S or Y,
$X_4$ is A, S or T,
$X_5$ is P or S;
$X_1X_2X_3X_4X_5X_6X_7X_8T$ (SEQ ID NO:1048), wherein
$X_1$ is L or Q, $X_2$ is K, N or Q,
$X_3$ is A, H, S or Y,
$X_4$ is H, N or Y,
$X_5$ is N, S or T,
$X_6$ is A, F, I, T, V or Y,
$X_7$ is P or no amino acid,
$X_8$ is F, L or P;
$QX_1X_2DX_3LPX_4X_5$ (SEQ ID NO:1049), wherein
$X_1$ is H or Q,
$X_2$ is C or Y,
$X_3$ is D, I, N, S or Y,
$X_4$ is F, I or L,
$X_5$ is A, S or T;
$QQX_1X_2X_3X_4PX_5X_6X_7$ (SEQ ID NO:1050), wherein
$X_1$ is H or Y,
$X_2$ is G or N,
$X_3$ is N or S,
$X_4$ is S or W,
$X_5$ is P or no amino acid,
$X_6$ is R or W,
$X_7$ is S or T; or
$X_1QYX_2X_3X_4X_5X_6X_7F$ (SEQ ID NO:1051), wherein
$X_1$ is H or Q,
$X_2$ is F or Y,
$X_3$ is G, I or S,
$X_4$ is F, I or T,
$X_5$ is M, P, S or T,
$X_6$ is F, L, R or W,
$X_7$ is S or T.

The isolated antigen binding protein may also comprise B) a heavy chain complementary determining region (CDRH) selected from the group consisting of: (i) a CDRH3 selected from the group consisting of SEQ ID NOs:332-372; (ii) a CDRH3 that differs in amino acid sequence from the CDRH3 of (i) by an amino acid addition, deletion or substitution of not more than two amino acids; and iii) a CDRH3 amino acid sequence selected from the following:

$X_1X_2X_3X_4X_5X_6X_7X_8X_9X_{10}X_{11}DX_{12}$ (SEQ ID NO:1065), wherein
$X_1$ is E or S,
$X_2$ is D, G or no amino acid,
$X_3$ is D, N or no amino acid,
$X_4$ is G or no amino acid,
$X_5$ is G or no amino acid,
$X_6$ is W, Y or no amino acid,
$X_7$ is I, N or Y,
$X_8$ is A or Y,
$X_9$ is G, V or Y,
$X_{10}$ is A, F or G,
$X_{11}$ is F, L or M,
$X_{12}$ is V or Y;
$QX_1X_2X_3X_4X_5X_6X_7X_8X_9X_{10}X_{11}YX_{12}X_{13}X_{14}DX_{15}$ (SEQ ID NO:1066), wherein
$X_1$ is G or no amino acid,
$X_2$ is K, L or Y,
$X_3$ is A, G or S,
$X_4$ is S, V or Y,
$X_5$ is A or G,
$X_6$ is G or no amino acid,
$X_7$ is T or no amino acid,
$X_8$ is S or no amino acid,
$X_9$ is Y or no amino acid,
$X_{10}$ is W or Y,
$X_{11}$ is G, S or Y,
$X_{12}$ is F or Y,
$X_{13}$ is G or no amino acid,
$X_{14}$ is M or no amino acid, $X_{15}$ is V or Y;

$X_1X_2X_3X_4X_5X_6X_7X_8X_9X_{10}X_{11}X_{12}X_{13}X_{14}$ (SEQ ID NO:1067), wherein $X_1$ is D, G, L, S or no amino acid,
$X_2$ is G, H, W, Y or no amino acid,
$X_3$ is A, F, W, Y or no amino acid,
$X_4$ is D, G, Q, T or no amino acid,
$X_5$ is G, I, Q, S or no amino acid,
$X_6$ is A, D, N, Q, S or no amino acid,
$X_7$ is G, Y or no amino acid,
$X_8$ is D, Y or no amino acid,
$X_9$ is Y or no amino acid,
$X_{10}$ is A, E, N or Y,
$X_{11}$ is G, P, T, V or Y,
$X_{12}$ is F or I,
$X_{13}$ is D or Q,
$X_{14}$ is C, H, V or Y;

$X_1X_2X_3X_4X_5X_6X_7X_8X_9X_{10}X_{11}X_{12}X_{13}X_{14}X_{15}X_{16}X_{17}DX_{18}$ (SEQ ID NO:1068), wherein $X_1$ is E, D or no amino acid,
$X_2$ is G, R or no amino acid,
$X_3$ is I, V, Y or no amino acid,
$X_4$ is A, G, L or N,
$X_5$ is A, G, V or W,
$X_6$ is A, N, R or T,
$X_7$ is G, N, P or no amino acid,
$X_8$ is G, T or no amino acid,
$X_9$ is A or no amino acid,
$X_{10}$ is D, E or no amino acid,
$X_{11}$ is S, Y or no amino acid,
$X_{12}$ is G, Y or no amino acid,
$X_{13}$ is N, Y or no amino acid,
$X_{14}$ is Y or no amino acid,
$X_{15}$ is D, Y or no amino acid,
$X_{16}$ is A, G or no amino acid,
$X_{17}$ is F or M,
$X_{18}$ is I, V or Y;

$X_1X_2X_3X_4X_5X_6X_7X_8X_9X_{10}X_{11}X_{12}X_{13}X_{14}X_{15}X_{16}X_{17}X_{18}X_{19}X_{20}X_{21}X_{22}X_{23}$ (SEQ ID NO:1069), wherein $X_1$ is A, D, G, S or T,
$X_2$ is A, E, G, L, N, R, Y or no amino acid,
$X_3$ is A, G, L, N, R, T, Y or no amino acid,
$X_4$ is D, G, R, S, V, Y or no amino acid,
$X_5$ is A, G, I, S, V, Y or no amino acid,
$X_6$ is F, G, L, R, V or no amino acid,
$X_7$ is L, T, Y or no amino acid,
$X_8$ is Y or no amino acid,
$X_9$ is Y or no amino acid,
$X_{10}$ is D or no amino acid,
$X_{11}$ is S or no amino acid,
$X_{12}$ is S or no amino acid,
$X_{13}$ is G or no amino acid,
$X_{14}$ is D, L, M, S, Y or no amino acid,
$X_{15}$ is H, I, P, V, W or no amino acid,
$X_{16}$ is F, G, L, R, S, Y or no amino acid,
$X_{17}$ is D, F, V, W, Y or no amino acid,
$X_{18}$ is C, F, L, P, S or Y,
$X_{19}$ is D, F, G or Y,
$X_{20}$ is A, C, G, P, R, V or Y,
$X_{21}$ is F, L, M, S or no amino acid,
$X_{22}$ is A, D or no amino acid,
$X_{23}$ is I, L, V, Y or no amino acid;

$X_1YSSGWX_2X_3YGX_4X_5DX_6$ (SEQ ID NO:1070), wherein $X_1$ is M or V,
$X_2$ is S or no amino acid,
$X_3$ is F or no amino acid,
$X_4$ is V or no amino acid,
$X_5$ is F or M,
$X_6$ is V or Y; or $RX_1X_2X_3PFX_4Y$ (SEQ ID NO:1071), wherein
$X_1$ is G, H, L, N or R,
$X_2$ is E, T or W,
$X_3$ is L, N, T or V,
$X_4$ is D or E.

In another aspect, the isolated antigen binding protein may further comprise A) a CDRL selected from: (i) a CDRL1 selected from SEQ ID NOs:189-217; (ii) a CDRL1 that differs in amino acid sequence from the CDRH1 of (i) by an amino acid addition, deletion or substitution of not more than two amino acids; or (iii) a CDRL1 amino acid sequence from the following:

$X_1SSQSLX_2X_3SDGX_4TYLX_5$ (SEQ ID NO:1035), wherein
$X_1$ is K or R,
$X_2$ is L or V,
$X_3$ is H or Y,
$X_4$ is K or N,
$X_5$ is N, S or Y;

$RASQX_1ISX_2YLN$ (SEQ ID NO:1036), wherein
$X_1$ is R, S or T,
$X_2$ is R or S;

$RASQX_1IX_2X_3X_4LX_5$ (SEQ ID NO:1037), wherein
$X_1$ is D, G, S or T,
$X_2$ is A, R or S,
$X_3$ is H, I, N, R, S or T,
$X_4$ is D, W or Y,
$X_5$ is A, G or N;

$QASQDIX_1X_2X_3LN$ (SEQ ID NO:1038), wherein
$X_1$ is S or T,
$X_2$ is D or N,
$X_3$ is S or Y;

$RASQX_1VX_2X_3X_4X_5LA$ (SEQ ID NO:1039), wherein
$X_1$ is S or T,
$X_2$ is I or S,
$X_3$ is R or S,
$X_4$ is S, N or no amino acid,
$X_5$ is Y or no amino acid; or $KSSQX_1X_2LX_3X_4SNNKNYLX_5$ (SEQ ID NO:1040), wherein
$X_1$ is N or S,
$X_2$ is I or V,
$X_3$ is D or Y,
$X_4$ is N, R or S,
$X_5$ is A or V;

(iv) a CDRL2 from the group consisting of SEQ ID NOs: 218-233; (v) a CDRL2 that differs in amino acid sequence from the CDRL2 of (iv) by an amino acid addition, deletion or substitution of not more than two amino acids; or (vi) a CDRL2 amino acid sequence from the following:

$X_1X_2SNX_3X_4S$ (SEQ ID NO:1041), wherein
$X_1$ is E or K,
$X_2$ is I or V,
$X_3$ is R or W,
$X_4$ is D or F;

$X_1X_2SX_3LQS$ (SEQ ID NO:1042), wherein
$X_1$ is A or T,
$X_2$ is A, E or V,
$X_3$ is S or T;

$X_1ASX_2LQS$ (SEQ ID NO:1043), wherein
$X_1$ is A or V,
$X_2$ is S or T;

DASX$_1$LET (SEQ ID NO:1044), wherein
X$_1$ is I or N;
GASSRAT (SEQ ID NO:223); or
WASX$_1$RES (SEQ ID NO:1045), wherein
X$_1$ is A or T.

The isolated antigen binding proteins may further comprise B) a CDRH from the group consisting of: (i) a CDRH1 from the group consisting of SEQ ID NOs:275-299; (ii) a CDRH1 that differs in amino acid sequence from the CDRH1 of (i) by an amino acid addition, deletion or substitution of not more than two amino acids; (iii) a CDRH1 amino acid sequence selected from:

GYTX$_1$TX$_2$X$_3$X$_4$X$_5$X$_6$ (SEQ ID NO:1052), wherein
X$_1$ is F or L,
X$_2$ is E, G or S,
X$_3$ is H, L or Y,
X$_4$ is G, S or Y,
X$_5$ is I or M,
X$_6$ is H or S;
GYX$_1$FTSYWIG (SEQ ID NO:1053), wherein
X$_1$ is R or S;
GFTFX$_1$SX$_2$X$_3$MH (SEQ ID NO:1054), wherein
X$_1$ is R or S,
X$_2$ is H or Y,
X$_3$ is D or G;
GFX$_1$FSX$_2$YX$_3$MX$_4$ (SEQ ID NO:1055), wherein
X$_1$ is P or T,
X$_2$ is A, R or 5,
X$_3$ is A or S,
X$_4$ is N or 5;
GX$_1$SX$_2$SX$_3$X$_4$X$_5$X$_6$X$_7$WX$_8$ (SEQ ID NO:1056), wherein
X$_1$ is D or G,
X$_2$ is F, I or V,
X$_3$ is R, S or no amino acid,
X$_4$ is G, Y or no amino acid,
X$_5$ is D, G, S or no amino acid,
X$_6$ is A, S or Y,
X$_7$ is A or Y,
X$_8$ is N or S;
GFSLSNARMGVS (SEQ ID NO:279); or
GFSLX$_1$TGGVGVG (SEQ ID NO:1057), wherein
X$_1$ is S or N;
(iv) a CDRH2 selected from the group consisting of SEQ ID NOs:300-331; (v) a CDRH2 that differs in amino acid sequence from the CDRH2 of (iv) by an amino acid addition, deletion or substitution of not more than two amino acids; or (vi) a CDRH2 amino acid sequence from the following:

X$_1$X$_2$X$_3$X$_4$X$_5$X$_6$GX$_7$TX$_8$X$_9$X$_{10}$QKX$_{11}$X$_{12}$ (SEQ ID NO:1058), wherein
X$_1$ is S or W,
X$_2$ is F or I,
X$_3$ is D, N or S,
X$_4$ is A or P,
X$_5$ is E, N or S,
X$_6$ is D, N or S,
X$_7$ is E, G or N,
X$_8$ is I or N,
X$_9$ is C, H or Y,
X$_{10}$ is A or T,
X$_{11}$ is F or L,
X$_{12}$ is D or G;
IIYPX$_1$DSDX$_2$RYSPSFQG (SEQ ID NO:1059), wherein
X$_1$ is D or G,
X$_2$ is A, I or T;
X$_1$IX$_2$X$_3$DGSX$_4$X$_5$X$_6$YX$_7$DSVX$_8$G (SEQ ID NO:1060), wherein
X$_1$ is F or V,
X$_2$ is S or W,
X$_3$ is D, S or Y,
X$_4$ is I, N or T,
X$_5$ is K or Q,
X$_6$ is N, R or Y,
X$_7$ is A, T or V,
X$_8$ is K or R;
X$_1$ISX$_2$SX$_3$X$_4$X$_5$X$_6$YYADSVKG (SEQ ID NO:1061), wherein
X$_1$ is A, H or Y,
X$_2$ is G, R or S,
X$_3$ is G or S,
X$_4$ is G, R or S,
X$_5$ is S, T or Y,
X$_6$ is I or T;
X$_1$X$_2$X$_3$X$_4$X$_5$X$_6$X$_7$X$_8$X$_9$X$_{10}$X$_{11}$YX$_{12}$X$_{13}$SX$_{14}$KS (SEQ ID NO:1062), wherein
X$_1$ is E, R or Y,
X$_2$ is I or T,
X$_3$ is H, N or Y,
X$_4$ is C, H, S, T or Y,
X$_5$ is S or R,
X$_6$ is G or S,
X$_7$ is G, K, S or T,
X$_8$ is T or W,
X$_9$ is N or Y,
X$_{10}$ is N or no amino acid,
X$_{11}$ is D or no amino acid,
X$_{12}$ is A or N,
X$_{13}$ is P or V,
X$_{14}$ is L or V;
X$_1$IFSNDEKSYSTSLKS (SEQ ID NO:1063), wherein
X$_1$ is H or LI; or
LIYWNX$_1$X$_2$KRYSPSLX$_3$S (SEQ ID NO:1064), wherein
X$_1$ is D or V,
X$_2$ is D or E,
X$_3$ is K or R.

In yet another embodiment, the isolated antigen binding protein described hereinabove comprises the first amino acid sequence and the second amino acid sequence, both sequences of which are covalently bonded to each other. The first amino acid sequence also comprises CDRL3 of SEQ ID NOs:234-274, CDRL2 of SEQ ID NOs:218-233, and CDRL1 of SEQ ID NOs:189-217, and the second amino acid sequence comprises said CDRH3 of SEQ ID NOs:332-372, CDRH2 of SEQ ID NOs:300-331, and CDRH1 of SEQ ID NOs:275-299.

In one aspect, the isolated antigen binding proteins can be a monoclonal antibody, a polyclonal antibody, a recombinant antibody, a human antibody, a humanized antibody, a chimeric antibody, a multispecific antibody, or an antibody fragment thereof. The antibody fragment may be a Fab fragment, a Fab' fragment, a F(ab')$_2$ fragment, a Fv fragment, a diabody, or a single chain antibody molecule. In one embodiment, the isolated antigen binding protein of the present invention is a human antibody. In another embodiment, the isolated antigen binding protein is a monoclonal antibody.

The isolated antigen binding proteins as described herein, may be of any of the following types: IgG1-, IgG2- IgG3- or IgG4-type. In one embodiment, the antigen binding protein is of the IgG2- or IgG4-type. Furthermore, the antigen binding protein may be coupled to a labeling group. These labeling groups may be, for example, a radioisotope, radionuclide, a fluorescent group, an enzymatic group, a chemiluminescent group, a biotinyl group, or a predetermined polypeptide group.

In another embodiment, the isolated antigen binding protein is coupled to an effector group such as, for example, a radioisotope, a radionuclide, a toxin, a therapeutic group, or a chemotherapeutic group. The chemotherapeutic groups may be, for example, calicheamicin, auristatin-PE, geldanamycin, maytanasine, or derivatives thereof.

In yet another embodiment, the isolated antigen binding protein competes for binding to human HB-EGF with a antigen binding protein as described and claimed herein. This competing antigen binding protein may be, for example, a monoclonal antibody, a polyclonal antibody, a recombinant antibody, a human antibody, a humanized'antibody, a chimeric antibody, a multispecific antibody, or an antibody fragment thereof. The antibody fragment may be, for example, a Fab fragment, a Fab' fragment, a F(ab')$_2$ fragment, a Fv fragment, a diabody, or a single chain antibody molecule. In one embodiment, the isolated binding protein is a human antibody. In another embodiment, the isolated antigen binding protein is a monoclonal antibody. In another embodiment, this isolated antigen binding protein is of the IgG1-, IgG2- IgG3- or IgG4-type. In one embodiment, the antigen binding protein is of the IgG2- or IgG4-type. In another embodiment, the antigen binding proteins as described herein can be coupled to a labeling group. Examples of labeling groups are: a radioisotope, radionuclide, a fluorescent group, an enzymatic group, a chemiluminescent group, a biotinyl group, or a predetermined polypeptide group. In another embodiment, the isolated antigen binding protein is coupled to an effector group such as, for example, a radioisotope, a radionuclide, a toxin, a therapeutic group, or a chemotherapeutic group. Examples of the therapeutic or chemotherapeutic groups include, for example, calicheamicin, auristatin-PE, geldanamycin, maytanasine, or derivatives thereof.

In one aspect, an isolated antigen binding protein is provided that reduces, at least partially, HB-EGF-mediated signal transduction.

Also presented herein is a nucleic acid molecule encoding the isolated antigen binding protein previously described, wherein the nucleic acid molecule is operably linked to a control sequence. In one aspect, a vector comprising the aforementioned nucleic acid molecule is provided. In another aspect, a host cell is provided that comprises the aforementioned nucleic acid molecule and/or vector.

In one embodiment, a method for making the antigen binding protein is provided that includes the step of preparing said antigen binding protein from a host cell that secretes said antigen binding protein.

In yet another embodiment, a pharmaceutical composition is provided comprising at least one of the aforementioned antigen binding proteins of the present invention and a pharmaceutically acceptable carrier, diluent or adjuvant. In one embodiment, the pharmaceutical composition may comprise an additional active agent, such as an anti-neoplastic agent. The anti-neoplastic agent may be, for example, an anti-tumor antibody. Examples of an anti-tumor antibody may be, for example, antibodies directed against receptor tyrosine kinase or EGFR.

In one aspect, the pharmaceutical composition is used for diagnosis, prevention or treatment of a hyperproliferative disease. In a further aspect, the hyperproliferative disease is associated with HB-EGF expression. In another aspect, the hyperproliferative disease is associated with or accompanied by a disturbed, (e.g. pathologically enhanced), growth factor receptor activation, wherein said pathologically enhanced growth factor receptor activation is associated with or caused by a pathological increase in the activity of a G protein and/or a G protein coupled receptor.

In one embodiment, the pharmaceutical composition comprises at least one antigen binding protein and pharmaceutically acceptable carrier, diluents and/or adjuvants for the diagnosis, prevention or treatment of cancer, such as, for example, breast cancer, gastrointestinal cancer, pancreas cancer, prostate cancer, ovarian cancer, stomach cancer, endometrial cancer, salivary gland cancer, lung cancer, kidney cancer, colon cancer, colorectal cancer, thyroid cancer, bladder cancer, glioma, melanoma, other HB-EGF expressing or overexpressing cancers, and formation of tumor metastases.

In another embodiment, antigen binding proteins as described herein are used for the manufacture of a pharmaceutical composition for the diagnosis, prevention or treatment of a hyperproliferative disease. In a further embodiment, the hyperproliferative disease is associated with HB-EGF expression.

One embodiment describes a method for diagnosing a condition associated with the expression of HB-EGF, the method comprising the step of contacting a sample an isolated antigen binding proteins as described herein, and determining the presence of HB-EGF in said sample. In a further embodiment, the condition is a hyperproliferative disease associated with HB-EGF expression.

Another aspect describes a method for preventing or treating a condition associated with the expression of HB-EGF in a patient, comprising administering to a patient in need thereof an effective amount of a antigen binding protein as described herein. In a further aspect, the condition is a hyperproliferative disease associated with HB-EGF expression. In yet another aspect, the patient is a mammalian patient.

In one embodiment, a kit is provided that comprises a antigen binding protein, a nucleic acid molecule, or a vector as described above. In a further embodiment, the kit comprises at least one further active agent, wherein the further active agent is an anti-neoplastic agent.

These and other aspects of the invention will be described in greater detail herein. Each of the aspects of the invention can encompass various embodiment of the present invention. It is therefore anticipated that each of the embodiments of the invention involving one element or combinations of elements can be included in each aspect of the invention. Other features, objects, and advantages of the present invention are apparent in the detailed description that follows.

DESCRIPTION OF THE FIGURES

FIGS. 1A-1P depict various light chain variable regions of the antigen binding proteins. The CDR1, CDR2 and CDR3 regions are indicated in boxes.

FIGS. 2A-2O depict various heavy chain variable regions of the antigen binding proteins. The CDR1, CDR2 and CDR3 regions are indicated in boxes.

FIGS. 3A-3K depict the amino acid sequences of various light chains of the antigen binding proteins.

FIGS. 4A-4O depict the amino acid sequences of various heavy chains of the antigen binding proteins.

FIG. 5A depicts the amino acid sequence of an exemplary light chain constant region of the antigen binding proteins.

FIG. 5B depicts the amino acid sequence of an exemplary heavy chain constant region of the antigen binding proteins.

FIGS. 6A-6F depict the amino acid sequences for various CDR regions of the light chain variable regions of the antigen binding proteins.

FIGS. 7A-7E depict the amino acid sequences for various CDR regions of the heavy chain variable regions of the antigen binding proteins.

FIGS. 8A-8H depict the amino acid sequences for various FR regions of the light chain variable regions of the antigen binding proteins.

FIGS. 9A-9F depict the amino acid sequences for various FR regions of the heavy chain variable regions of the antigen binding proteins.

FIGS. 10A and 10B depict an alignment of the amino acid sequences of the light chain variable sequences of the antigen binding proteins. The CDR1, CDR2 and CDR3 regions are shown in boxes.

FIGS. 11A and 11B depict an alignment of the amino acid sequences of the heavy chain variable sequences of the antigen binding proteins. The CDR1, CDR2 and CDR3 regions are shown in boxes.

FIGS. 13A-13V depict the nucleotide sequences of various light chain variable regions of the antigen binding proteins.

FIGS. 14A-14AC depict the nucleotide sequences of various heavy chain variable regions of the antigen binding proteins.

FIGS. 15A-15M depict the nucleotide sequences of the various light chains of the antigen binding proteins.

FIGS. 16A-16L depict the nucleotide sequences of the various heavy chains of the antigen binding proteins.

FIG. 17A depicts the nucleotide sequence of the light chain constant region of the antigen binding proteins.

FIG. 17B depicts the nucleotide sequence of the heavy chain constant region of the antigen binding proteins.

FIGS. 18A-18F depict the nucleotide sequences for various CDR regions of the light chain variable regions of the antigen binding proteins.

FIGS. 19A-19G depict the nucleotide sequences for various CDR regions of the heavy chain variable regions of the antigen binding proteins.

FIGS. 20A-20K depict the nucleotide sequences for various FR regions of the light chain variable regions of the antigen binding proteins.

FIGS. 21A-21K depict the nucleotide sequences for various FR regions of the heavy chain variable regions of the antigen binding proteins.

FIG. 31 shows that HB-EGF is expressed on human vascular endothelial cells (HUVECs), as detected by FACS analysis.

FIGS. 32A-32B show that while HB-EGF stimulates HUVEC cellular proliferation, anti-HB-EGF antibody preparations inhibited basal proliferation by about 8% to 14%. HB-EGF stimulates HUVEC cellular proliferation by about 38% (FIG. 32A). However, upon addition of anti-HB-EGF antibody preparations U2-42, U2-39 or U2-45, basal cellular proliferation is inhibited by about 8% to 14% (FIG. 32B).

FIGS. 33A-33L illustrate that anti-HB-EGF antibodies accelerate HUVEC tube regression. HUVEC tube formation is a model system for endothelial cell angiogenesis. FIGS. 33A-33C provide control assays that were performed without anti-HB-EGF antibodies. As shown, HUVEC cells join to form many circular structures or "tubes." FIGS. 33D-33F illustrate the effects of adding the anti-HB-EGF U2-39 antibody preparation upon tube formation. FIGS. 33G-33I illustrate the effects of adding the anti-HB-EGF U2-42 antibody preparation upon tube formation. FIGS. 33J-33L illustrate the effects of adding the anti-HB-EGF U2-45 antibody preparation upon tube formation. As shown, fewer HUVEC tubes are visible and the network is diminished when the U2-42, U2-39 and U2-45 anti-HB-EGF antibody preparations are present.

FIG. 33M graphically illustrates a quantitative evaluation of HUVEC tube formation after adding the anti-HB-EGF antibody preparations provided herein, supporting the utility of HB-EGF antibodies for inhibiting angiogenesis. The number of tubes or closed cell structures per microscopic field is plotted for the U2-42, U2-39 or U2-45 anti-HB-EGF antibody preparations. As shown, while approximately 10 HUVEC tubes were visible per field when no anti-HB-EGF antibodies were present, only about 4 HUVEC tubes were observed per microscopic field when the U2-39 anti-HB-EGF antibody preparation was added. In the presence of the U2-42 anti-HB-EGF antibody preparation only about 1 HUVEC tube was observed. When the U2-45 anti-HB-EGF antibody preparation was present only 6 HUVEC tubes were observed.

FIG. 34A illustrates that anti-HB-EGF antibodies inhibit HB-EGF-stimulated colony formation of OVCAR-8 ovarian cancer cells. As shown, HB-EGF stimulated OVCAR-8 cells to form a significantly larger mean colony size than control OVCAR-8 cells cultured without HB-EGF. However, when OVCAR-8 cells were cultured with anti-HB-EGF U2-39 antibodies in the presence of HB-EGF, mean colony size was reduced to the baseline size observed for control cells without HB-EGF treatment.

FIG. 34B illustrates that anti-HB-EGF antibodies inhibit HB-EGF-stimulated colony formation of BM1604 prostate cancer cells in soft agar. As shown, HB-EGF stimulated BM1604 cells to form a larger number of colonies per well than control BM1604 cells cultured without HB-EGF. However, when BM1604 cells were cultured with anti-HB-EGF U2-39 antibodies in the presence of HB-EGF, mean colony size was reduced to a size similar to that observed for control cells without HB-EGF treatment. Anti-HB-EGF U2-45 and U2-42 antibodies partially inhibited colony formation, while, in this assay, the U2-39 anti-HB-EGF antibody completely inhibited colony formation.

FIG. 34C illustrates that anti-HB-EGF antibodies inhibit HB-EGF-stimulated colony formation of NCI-H226 lung carcinoma cells. As shown, HB-EGF stimulated NCI-H226 cells to form a significantly larger mean colony size than control NCI-H226 cells cultured without HB-EGF. However, when NCI-H226 cells were cultured with anti-HB-EGF U2-39 antibodies in the presence of HB-EGF, mean colony size was reduced to the baseline size observed for control cells without HB-EGF treatment.

FIG. 34D illustrates that anti-HB-EGF antibodies inhibit basal colony formation of SkOV-3 HB-EGF clone 71 cells, derived from SkOV-3 ovarian cancer cells transfected with an HB-EGF expression vector to cause constitutive over-expression of HB-EGF. As shown, control SkOV-3 HB-EGF clone 71 cells formed large numbers of colonies. However, when SkOV-3 HB-EGF cl. 71 cells were cultured with either anti-HB-EGF U2-42 or U2-39 antibodies, the number of colonies was dramatically reduced.

FIG. 34E illustrates that anti-HB-EGF antibodies inhibit basal colony formation of SkOV-3 HB-EGFclone 74 cells, derived from SkOV-3 ovarian cancer cells transfected with an HB-EGF expression vector to cause constitutive over-expression of HB-EGF. As shown, control SkOV-3 HB-EGF clone 74 cells formed large numbers of colonies. However, when SkOV-3 HB-EGF clone 74 cells were cultured with anti-HB-EGF U2-39 antibodies, the number of colonies was dramatically reduced.

FIG. 34F illustrates that anti-HB-EGF antibodies inhibit basal colony formation of BxPC3 pancreatic adenocarcinoma cells grown in soft agar. As shown, control BxPC3 cells formed large numbers of colonies. However, when BxPC3 cells were cultured with either anti-HB-EGF U2-42 or U2-39 antibodies in the presence of HB-EGF, the number of colonies was dramatically reduced.

As shown in FIG. 38B, efficacy of inhibition of the xenograft tumor growth by antibodies U2-42 and U2-39 was shown to be dose dependent. Moreover, combination treatment with the anti-EGFR antibody Erbitux leads to complete regression of tumor growth and shows the potent synergistic activity of the anti-HB-EGF antibodies as agents for combination therapy (FIG. 38C).

FIG. 40A illustrates a scratch assay indicating the inhibition of HB-EGF-induced migration of CLS354 epithelial squamous carcinoma cells (mouth).

FIG. 40B illustrates a transmigration assay indicating the inhibition of HB-EGF-induced migration of Detroit 562 epithelial carcinoma cells (pharynx).

FIG. 42 illustrates immunohistochemistry (IHC) analysis of human tumor xenograft samples indicating the inhibition of CD31 staining of tumor in vivo.

DETAILED DESCRIPTION

Figure 12A:
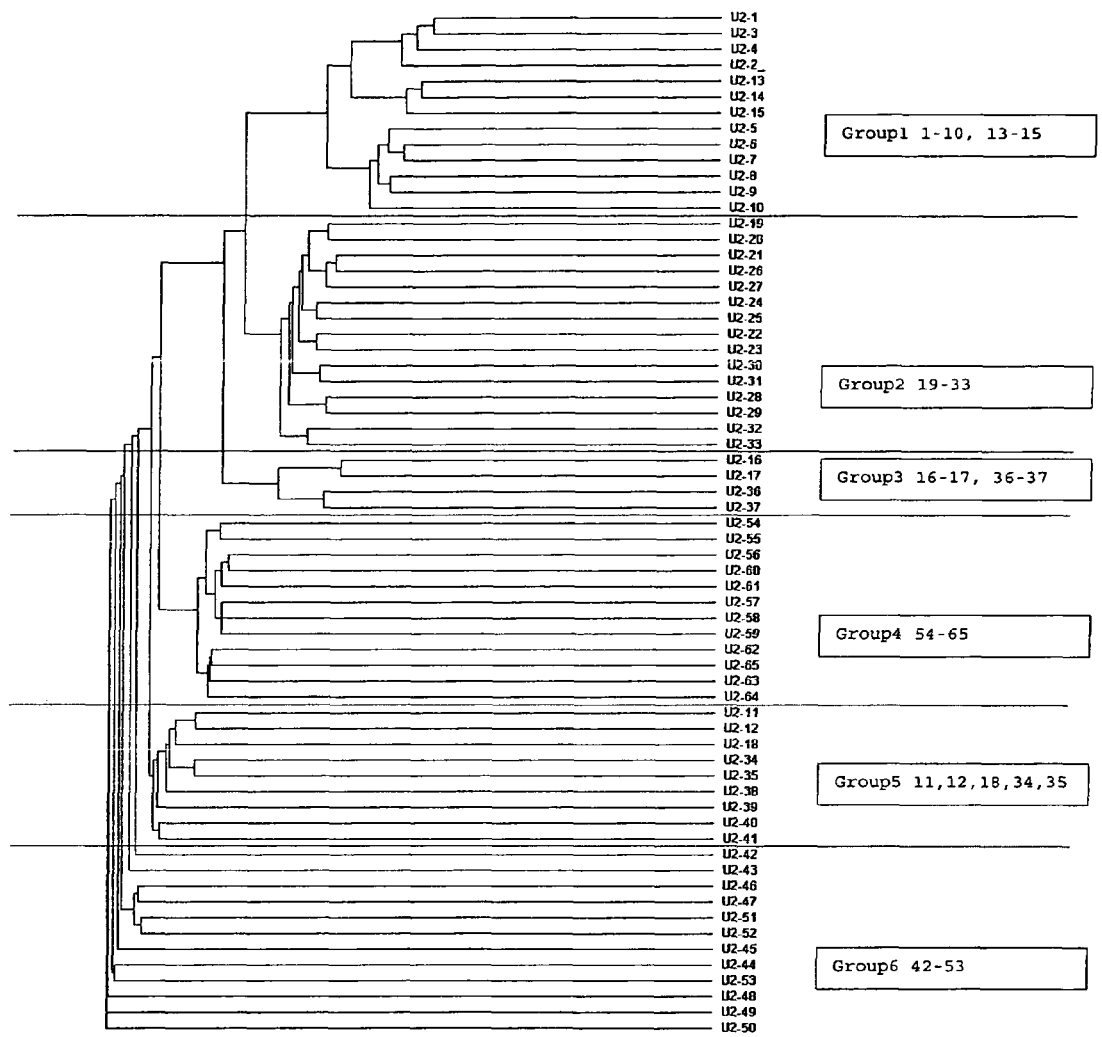
FIG. 12A depicts a cladogram showing the relatedness of the light chain variable regions of the antigen binding proteins.

The section headings used herein are for organizational purposes only and are not to be construed as limiting the subject matter described.

Unless otherwise defined herein, scientific and technical terms used in connection with the present application shall have the meanings that are commonly understood by those of ordinary skill in the art. Further, unless otherwise required by context, singular terms shall include pluralities and plural terms shall include the singular.

Generally, nomenclatures used in connection with, and techniques of, cell and tissue culture, molecular biology, immunology, microbiology, genetics and protein and nucleic acid chemistry and hybridization described herein are those well known and commonly used in the art. The methods and techniques of the present application are generally performed according to conventional methods well known in the art and as described in various general and more specific references that are cited and discussed throughout the present specification unless otherwise indicated. See, e.g., Sambrook et al., Molecular Cloning: A Laboratory Manual, 3rd ed., Cold Spring Harbor Laboratory Press, Cold Spring Harbor, N.Y. (2001) and Ausubel et al., Current Protocols in Molecular Biology, Greene Publishing Associates (1992), and Harlow and Lane Antibodies: A Laboratory Manual Cold Spring Harbor Laboratory Press, Cold Spring Harbor, N.Y. (1990), which are incorporated herein by reference. Enzymatic reactions and purification techniques are performed according to manufacturer's specifications, as commonly accomplished in the art or as described herein. The terminology used in connection with, and the laboratory procedures and techniques of, analytical chemistry, synthetic organic chemistry, and medicinal and pharmaceutical chemistry described herein are those well known and commonly used in the art. Standard techniques can be used for chemical syntheses, chemical analyses, pharmaceutical preparation, formulation, and delivery, and treatment of patients.

It should be understood that this invention is not limited to the particular methodology, protocols, and reagents, etc., described herein and as such may vary. The terminology used herein is for the purpose of describing particular embodiments only, and is not intended to limit the scope of the disclosed, which is defined solely by the claims.

Other than in the operating examples, or where otherwise indicated, all numbers expressing quantities of ingredients or reaction conditions used herein should be understood as modified in all instances by the term "about." The term "about" when used in connection with percentages may mean±1%.

A. General Overview

Antigen binding proteins that bind HB-EGF protein, in particular human HB-EGF (hHB-EGF) protein are provided herein. The antigen binding proteins provided are polypeptides into which one or more complementary determining regions (CDRs), as described herein, are embedded and/or joined. In some antigen binding proteins, the CDRs are embedded into a "framework" region, which orients the CDR(s) such that the proper antigen binding properties of the CDR(s) is achieved. In general, antigen binding proteins that are provided can interfere with, block, reduce or modulate the interaction between HB-EGF and its cognate receptors, including EGF-R and HER4.

Certain antigen binding proteins described herein are antibodies or are derived from antibodies. In certain embodiments, the polypeptide structure of the antigen binding proteins is based on antibodies, including, but not limited to, monoclonal antibodies, bispecific antibodies, minibodies, domain antibodies, synthetic antibodies (sometimes referred to herein as "antibody mimetics"), chimeric antibodies, humanized antibodies, human antibodies, antibody fusions (sometimes referred to herein as "antibody conjugates"), and fragments thereof, respectively. The various structures are further described herein below.

The antigen binding proteins provided herein have been demonstrated to bind to several epitopes of HB-EGF, in particular human HB-EGF. As demonstrated in the examples, the ability of HB-EGF to bind to its cognate receptors is reduced or inhibited. As a consequence, the antigen binding proteins provided herein are capable of inhibiting the activity of HB-EGF. In particular, antigen binding proteins binding to these epitopes can have one or more of the following activities: inhibiting, inter alia, EGF-R and HER4 autophosphorylation, induction of EGF-R and HER4 signal transduction pathway, EGF-R and HER4 induced cell growth, and other physiological effects induced by EGF-R and HER4 upon HB-EGF binding.

The antigen binding proteins that are disclosed herein have a variety of utilities. Some of the antigen binding proteins, for instance, are useful in specific binding assays, affinity purification of HB-EGF, in particular hHB-EGF and in screening assays to identify pof such receptors. In addition, the disclosed antigen binding proteins may be used for the diagnosis and/or treatment of disease, such as proliferative disorders. These include, but are not limited to, various types of cancer.

B. Heparin-Binding Epidermal Growth Factor-Like Growth Factor (HB-EGF)

HB-EGF is produced by various tumor cells and acts as an autocrine tumor growth factor. Davis-Fleischer et al., 1998, *Front Biosci.* 3:288-299; Iwamoto & Mekada, 2000, *Cytokine Growth Factor Rev.* 11:335-344. HB-EGF has a strong affinity for heparin which can increase the biological activity of HB-EGF. HB-EGF is produced as a transmembrane protein which is proteolytically cleaved by metalloproteinases to yield the mature soluble form of the growth factor.

HB-EGF was first identified from supernatants of cultured human macrophages in a soluble, secreted form. On human cells, the precursor proHB-EGF, acts as the diphtheria toxin receptor. Various cell types, including epithelial cells, keratinocytes, monocytes, mesangial cells, lymphoid cells, and skeletal muscle cells, produce HB-EGF. It is a potent mitogen and chemotactic factor for epithelial cells, fibroblasts, smooth muscle cells and various human cancer cells.

The transmembrane form of HB-EGF is synthesized by many cell types as a 208-amino acid transmembrane precursor (tm-HB-EGF) containing EGF, heparin-binding, transmembrane, and cytoplasmic domains. The extracellular domain can be released as a 12- to 22-kDa soluble form of HB-EGF (sol-HB-EGF) through the action of metalloproteinases, which is regulated by different G protein-coupled receptors (GPCRs) or tumor promoters such as tetradecanoyl phorbol acetate (TPA). Typically, a substantial amount of transmembrane HB-EGF precursor remains uncleaved on the cell surface.

Both tm-HB-EGF and sol-HB-EGF are biologically active. The biological functions of both sol- and tm-HB-EGF are mediated by the EGF receptor (EGFR; HER1) and ErbB4 (HER4). Activation of these types of these receptors is believed to occur as a consequence of ligand-induced receptor homo- or hetero-dimerization. Upon activation, the EGF receptor has been demonstrated to increase cell growth, increase cell motility, inhibit apoptosis and increase cellular transformation.

EGFR-dependent signaling pathways can be transactivated upon stimulation of G-protein-coupled receptors (GPCR). Ligand activation of heterotrimeric G proteins by interaction with a GPCR results in an intracellular signal that induces the extracellular activity of a transmembrane metalloproteinase. Ligands that activate the GPCR pathway include LPA (lysophosphatidic acid), thrombin, carbachol, bombesin, and endothelin. Such activation leads to extracellular processing of a transmembrane growth factor precursor and release of the mature factor which, directly or through the proteoglycan matrix, interacts with the ectodomain of EGFR and activates it through tyrosine phosphorylation. See, Prenzel et al., 1999, *Nature* 402:884-888. Thus, HB-EGF is a component of a triple membrane-passing signal (TMPS) mechanism whereby a GPCR activates a membrane-bound metalloproteinase, which cleaves proHB-EGF to release the soluble growth factor, which subsequently activates the EGF receptor. EGFR transactivation has been linked to various disease states such as cardiac hypertrophy (reviewed in Shah B H, Catt K J. Trends Pharmacol Sci. 2003 May; 24(5):239-244), vascular remodeling (reviewed in Eguchi et al., 2003, *Biochem Soc Trans*. 2003 December; 31(Pt 6):1198-202.) and cancer (reviewed in Fischer et al., 2003, supra).

Sequences for HB-EGF proteins and nucleic acids encoding those proteins are available to one of skill in the art. For example, such HB-EGF sequences can be found in the database provided by the National Center for Biotechnology Information (NCBI) (see, http://www.ncbi.nlm.nih.gov/). One example of a sequence for a HB-EGF is the amino acid sequence at NCBI accession numbers NM 001945 and NP_001936 (gi:4503413). This sequence is provided below for easy reference (SEQ ID NO:1072):

MKLLPSVVLKLFLAAVLSALVTGESLERLRRGLAAGTSNPDPPTVST

DQLLPLGGGRDRKVRDLQEADLDLLRVTLSSKPQALATPNKEEHGKR

KKKGKGLGKKRDPCLRKYKDFCIHGECKYVKELRAPSCICHPGYHGE

-continued

RCHGLSLPVENRLYTYDHTTILAVVAVVLSSVCLLVIVGLLMFRYHR

RGGYDVENEEKVKLGMTNSH.

Note that the HB-EGF sequence shown above (SEQ ID NO:1072) has the nineteen amino acid signal peptide (MKLLPSVVLK LFLAAVLSA, SEQ ID NO:1073).

The soluble extracellular domain consists of amino acids 1-149 of the above HB-EGF sequence. This sequence for the HB-EGF soluble extracellular domain is provided below as SEQ ID NO:1074:

MKLLPSVVLKLFLAAVLSALVTGESLERLRRGLAAGTSNPDPPTVST

DQLLPLGGGRDRKVRDLQEADLDLLRVTLSSKPQALATPNKEEHGKR

KKKGKGLGKKRDPCLRKYKDFCIHGECKYVKELRAPSCICHPGYHGE

RCHGLSLP.

Upon cleavage, a mature HB-EGF is generated that consists of amino acids 63-149 (87 amino acids). This sequence for the mature HB-EGF is provided below as SEQ ID NO:1075:

DLQEADLDLLRVTLSSKPQALATPNKEEHGKRKKKGKGLGKKRDPCL

RKYKDFCIHGECKYVKELRAPSCICHPGYHGERCHGLSLP.

HB-EGF interacts with and activates the epidermal growth factor receptor (EGFR). EGFR is a 170 kDa transmembrane glycoprotein consisting of an extracellular ligand-binding domain, a transmembrane region and an intracellular domain with tyrosine kinase activity. Binding of growth factors to the EGFR results in internalization of the ligand-receptor complex, autophosphorylation of the receptor and other protein substrates, leading ultimately to DNA synthesis and cell division. The external ligand binding domain is not only stimulated by HB-EGF, but also by EGF, TGFα and amphiregulin (AR).

Overexpression of the EGFR is often accompanied by the co-expression of EGF-like growth factors, suggesting that an autocrine pathway for control of growth may play a major part in the progression of tumors. It is now widely believed that this is a mechanism by which tumor cells can escape normal physiological control.

C. HB-EGF Receptor Antigen Binding Proteins

A variety of selective binding agents useful for regulating the activity of HB-EGF are provided. These agents include, for instance, antigen binding proteins that contain an antigen binding domain (e.g., single chain antibodies, domain antibodies, immunoadhesions, and polypeptides with an antigen binding region) and specifically bind to a HB-EGF polypeptide, in particular human HB-EGF. Some of the agents, for example, are useful in inhibiting the binding of HB-EGF to its receptors, and can thus be used to inhibit, interfere with, or modulate one or more activities associated with HB-EGF-mediated signaling.

In general, the antigen binding proteins that are provided typically comprise one or more CDRs as described herein (e.g., 1, 2, 3, 4, 5 or 6). In some instances, the antigen binding protein comprises (a) a polypeptide structure and (b) one or more CDRs that are inserted into and/or joined to the polypeptide structure. The polypeptide structure can take a variety of different forms. For example, it can be, or comprise, the framework of a naturally occurring antibody, or fragment or variant thereof, or may be completely synthetic in nature. Examples of various polypeptide structures are further described below.

In certain embodiments, the polypeptide structure of the antigen binding proteins is an antibody or is derived from an antibody, including, but not limited to, monoclonal antibodies, bispecific antibodies, minibodies, domain antibodies, synthetic antibodies (sometimes referred to herein as "antibody mimetics"), chimeric antibodies, humanized antibodies, antibody fusions (sometimes referred to as "antibody conjugates"), and portions or fragments of each, respectively. In some instances, the antigen binding protein is an immunological fragment of an antibody (e.g., a Fab, a Fab', a F(ab')$_2$, or a scFv). The various structures are further described and defined herein.

Certain of the antigen binding proteins as provided herein specifically bind to human HB-EGF. In a specific embodiment, the antigen binding protein specifically binds to human HB-EGF protein having the amino acid sequence of SEQ ID NO:1072.

In embodiments where the antigen binding protein is used for therapeutic applications, an antigen binding protein can inhibit, interfere with or modulate one or more biological activities of HB-EGF. In this case, an antigen binding protein binds specifically to and/or substantially inhibits binding of human HB-EGF to its receptor when an excess of antibody reduces the quantity of human HB-EGF bound to its receptor, or vice versa, by at least about 20%, 40%, 60%, 80%, 85%, or more (for example by measuring binding in an in vitro competitive binding assay). HB-EGF has many distinct biological effects, which can be measured in many different assays in different cell types; examples of such assays are provided herein.

1. Naturally Occurring Antibody Structure

Some of the antigen binding proteins that are provided have the structure typically associated with naturally occurring antibodies. The structural units of these antibodies typically comprise one or more tetramers, each composed of two identical couplets of polypeptide chains, though some species of mammals also produce antibodies having only a single heavy chain. In a typical antibody, each pair or couplet includes one full-length "light" chain (in certain embodiments, about 25 kDa) and one full-length "heavy" chain (in certain embodiments, about 50-70 kDa). Each individual immunoglobulin chain is composed of several "immunoglobulin domains", each consisting of roughly 90 to 110 amino acids and expressing a characteristic folding pattern. These domains are the basic units of which antibody polypeptides are composed. The amino-terminal portion of each chain typically includes a variable domain that is responsible for antigen recognition. The carboxy-terminal portion is more conserved evolutionarily than the other end of the chain and is referred to as the "constant region" or "C region". Human light chains generally are classified as kappa and lambda light chains, and each of these contains one variable domain and one constant domain. Heavy chains are typically classified as mu, delta, gamma, alpha, or epsilon chains, and these define the antibody's isotype as IgM, IgD, IgG, IgA, and IgE, respectively. IgG has several subtypes, including, but not limited to, IgG1, IgG2, IgG3, and IgG4. IgM subtypes include IgM1, and IgM2. IgA subtypes include IgA1 and IgA2. In humans, the IgA and IgD isotypes contain four heavy chains and four light chains; the IgG and IgE isotypes contain two heavy chains and two light chains; and the IgM isotype contains five heavy chains and five light chains. The heavy chain C region typically comprises one or more domains that may be responsible for effector function. The number of heavy chain constant region domains will depend on the isotype. IgG heavy chains, for example, contain three C region domains known as $C_H1$, $C_H2$ and $C_H3$. The antibodies that are provided can have any of these isotypes and subtypes. In certain embodiments, the HB-EGF antibody is of the IgG1, IgG2, or IgG4 subtype.

In full-length light and heavy chains, the variable and constant regions are joined by a "J" region of about twelve or more amino acids, with the heavy chain also including a "D" region of about ten more amino acids. See, e.g., Fundamental Immunology, 2nd ed., Ch. 7 (Paul, W., ed.) 1989, New York: Raven Press (hereby incorporated by reference in its entirety for all purposes). The variable regions of each light/heavy chain pair typically form the antigen binding site.

One example of a kappa Light Constant domain of an exemplary HB-EGF monoclonal antibody has the amino acid sequence:

(SEQ ID NO: 187)
RTVAAPSVFIFPPSDEQLKSGTASVVCLLNNFYPREAKVQWKVDNAL

QSGNSQESVTEQDSKDSTYSLSSTLTLSKADYEKHKVYACEVTHQGL

SSPVTKSFNRGEC.

One example of an IgG2 heavy constant domain of an exemplary HB-EGF monoclonal antibody has the amino acid sequence:

(SEQ ID NO: 188)
ASTKGPSVFPLAPCSRSTSESTAALGCLVKDYFPEPVTVSWNSGALT

SGVHTFPAVLQSSGLYSLSSVVTVPSSNFGTQTYTCNVDHKPSNTKV

DKTVERKCCVECPPCPAPPVAGPSVFLFPPKPKDTLMISRTPEVTCV

VVDVSHEDPEVQFNWYVDGVEVHNAKTKPREEQFNSTERVVSVLTVV

HQDWLNGKEYKCKVSNKGLPAPIEKTISKTKGQPREPQVYTLPPSRE

EMTKNQVSLTCLVKGFYPSDIAVEWESNGQPENNYKTTPPMLDSDGS

FFLYSKLTVDKSRWQQGNVFSCSVMHEALHNHYTQKSLSLSPGK.

Variable regions of immunoglobulin chains generally exhibit the same overall structure, comprising relatively conserved framework regions (FR) joined by three hypervariable regions, more often called "complementarity determining regions" or CDRs. The CDRs from the two chains of each heavy chain/light chain pair mentioned above typically are aligned by the framework regions to form a structure that binds specifically to a specific epitope on the target protein (e.g., HB-EGF). From N-terminal to C-terminal, naturally-occurring light and heavy chain variable regions both typically conform with the following order of these elements: FR1, CDR1, FR2, CDR2, FR3, CDR3 and FR4. A numbering system has been devised for assigning numbers to amino acids that occupy positions in each of these domains. This numbering system is defined in Kabat Sequences of Proteins of Immunological Interest (1987 and 1991, NIH, Bethesda, Md.), or Chothia & Lesk, 1987, *J. Mol. Biol.* 196:901-917; Chothia et al., 1989, *Nature* 342:878-883.

The various light chain and heavy chain variable regions provided herein are depicted in FIGS. 1A-1P, and FIGS. 2A-2O, respectively. Each of these variable regions may be attached to the above heavy and light chain constant regions to form a complete antibody heavy and light chain, respectively. Further, each of the so generated heavy and light chain sequences may be combined to form a complete antibody structure.

Specific examples of some of the full length light and heavy chains of the antibodies that are provided and their corresponding amino acid sequences are summarized in FIGS. 3A-3K and FIGS. 4A-4O, respectively.

Again, each of the exemplary light chains ($U_L$-1, $U_L$-2, $U_L$-3 etc.) listed in FIGS. 3A-3K can be combined with any of the exemplary heavy chains shown in FIGS. 4A-4O to form an antibody. Examples of such combinations include $U_L$-1 combined with any of $U_H$-1 through $U_H$-58; $U_L$-2 combined with any of $U_H$-1 through $U_H$-58; or $U_L$-3 combined with any of $U_H$-1 through $U_H$-58, and so on. In some instances, the antibodies include at least one light chain and one heavy chain from those listed in FIGS. 3A-3K and FIGS. 4A-4O, respectively. In other instances, the antibodies contain two identical light chains and two identical heavy chains. As an example, an antibody or immunologically functional fragment may include two $U_L$-1 light chains and two $U_H$-1 heavy chains, or two $U_L$-2 light chains and two $U_H$-2 heavy chains, or two $U_L$-3 light chains and two $U_H$-3 heavy chains and other similar combinations of pairs of light chains and pairs of heavy chains as listed in FIGS. 3A-3K and FIGS. 4A-4O, respectively.

Other antibodies that are provided are variants of antibodies formed by combination of the heavy and light chains shown in FIGS. 3A-3K and FIGS. 4A-4O, respectively, and comprise light and/or heavy chains that each have at least 70%, 75%, 80%, 85%, 90%, 95%, 97% or 99% identity to the amino acid sequences of these chains. In some instances, such antibodies include at least one light chain and one heavy chain, whereas in other instances the variant forms contain two identical light chains and two identical heavy chains.

2. Variable Domains of Antibodies

Also provided are antigen binding proteins that contain an antibody light chain variable region selected from the group consisting of U-$V_L$1, U-$V_L$2, U-$V_L$3, U-$V_L$4, U-$V_L$5, U-$V_L$6, U-$V_L$7, U-$V_L$8, U-$V_L$9, U-$V_L$10, U-$V_L$11, U-$V_L$12, U-$V_L$13, U-$V_L$14, U-$V_L$15, U-$V_L$16, U-$V_L$17, U-$V_L$18, U-$V_L$19, U-$V_L$20, U-$V_L$21, U-$V_L$22, U-$V_L$23, U-$V_L$24, U-$V_L$25, U-$V_L$26, U-$V_L$27, U-$V_L$28, U-$V_L$29, U-$V_L$30, U-$V_L$31, U-$V_L$32, U-$V_L$33, U-$V_L$34, U-$V_L$35, U-$V_L$36, U-$V_L$37, U-$V_L$38, U-$V_L$39, U-$V_L$40, U-$V_L$41, U-$V_L$42, U-$V_L$43, U-$V_L$44, U-$V_L$45, U-$V_L$46, U-$V_L$47, U-$V_L$48, U-$V_L$49, U-$V_L$50, U-$V_L$51, U-$V_L$52, U-$V_L$54, U-$V_L$55, U-$V_L$56, U-$V_L$57, U-$V_L$58, U-$V_L$59, U-$V_L$60, U-$V_L$61, U-$V_L$62, U-$V_L$64, and U-$V_L$65; and/or an antibody light chain variable region selected from the group consisting of U-$V_H$1, U-$V_H$2, U-$V_H$3, U-$V_H$4, U-$V_H$5, U-$V_H$6, U-$V_H$7, U-$V_H$8, U-$V_H$9, U-$V_H$10, U-$V_H$11, U-$V_H$12, U-$V_H$13, U-$V_H$14, U-$V_H$15, U-$V_H$16, U-$V_H$17, U-$V_H$18, U-$V_H$19, U-$V_H$20, U-$V_H$21, U-$V_H$22, U-$V_H$23, U-$V_H$24, U-$V_H$25, U-$V_H$26, U-$V_H$27, U-$V_H$28, U-$V_H$29, U-$V_H$30, U-$V_H$31, U-$V_H$32, U-$V_H$33, U-$V_H$34, U-$V_H$35, U-$V_H$36, U-$V_H$37, U-$V_H$38, U-$V_H$39, U-$V_H$40, U-$V_H$41, U-$V_H$42, U-$V_H$43, U-$V_H$44, U-$V_H$45, U-$V_H$46, U-$V_H$47, U-$V_H$48, U-$V_H$49, U-$V_H$50, U-$V_H$51, U-$V_H$52, U-$V_H$53, U-$V_H$54, U-$V_H$55, U-$V_H$56, U-$V_H$57, and U-$V_H$58, as shown in FIGS. 1A-1P, and FIGS. 2A-2O, respectively, and immunologically functional fragments, derivatives, muteins and variants of these light chain and heavy chain variable regions.

Sequence alignments of the various light and heavy chain variable regions, respectively, are provided in FIGS. 10A and 10B, and FIGS. 11A and 11B, respectively.

Antigen binding proteins of this type can generally be designated by the formula "$V_H$x/$V_L$y," where "x" corresponds to the number of heavy chain variable regions and y corresponds to the number of the light chain variable regions (in general, x and y are each 1 or 2).

Each of the light chain variable regions listed in FIGS. 1A-1P may be combined with any of the light chain variable regions shown in FIGS. 2A-2O to form an antigen binding protein. Examples of such combinations include U-$V_L$1 combined with any of U-$V_H$1, U-$V_H$2, U-$V_H$3, U-$V_H$4, U-$V_H$5, U-$V_H$6, U-$V_H$7, U-$V_H$8, U-$V_H$9, U-$V_H$10, U-$V_H$11, U-$V_H$12, U-$V_H$13, U-$V_H$14, U-$V_H$15, U-$V_H$16, U-$V_H$17, U-$V_H$18, U-$V_H$19, U-$V_H$20, U-$V_H$21, U-$V_H$22, U-$V_H$23, U-$V_H$24, U-$V_H$25, U-$V_H$26, U-$V_H$27, U-$V_H$28, U-$V_H$29, U-$V_H$30, U-$V_H$31, U-$V_H$32, U-$V_H$33, U-$V_H$34, U-$V_H$35, U-$V_H$36, U-$V_H$37, U-$V_H$38, U-$V_H$39, U-$V_H$40, U-$V_H$41, U-$V_H$42, U-$V_H$43, U-$V_H$44, U-$V_H$45, U-$V_H$46, U-$V_H$47, U-$V_H$48, U-$V_H$49, U-$V_H$50, U-$V_H$51, U-$V_H$52, U-$V_H$53, U-$V_H$54, U-$V_H$55, U-$V_H$56, U-$V_H$57, or U-$V_H$58, or U-$V_L$2 combined with any of U-$V_H$1, U-$V_H$2, U-$V_H$3, U-$V_H$4, U-$V_H$5, U-$V_H$6, U-$V_H$7, U-$V_H$8, U-$V_H$9, U-$V_H$10, U-$V_H$11, U-$V_H$12, U-$V_H$13, U-$V_H$14, U-$V_H$15, U-$V_H$16, U-$V_H$17, U-$V_H$18, U-$V_H$19, U-$V_H$20, U-$V_H$21, U-$V_H$22, U-$V_H$23, U-$V_H$24, U-$V_H$25, U-$V_H$26, U-$V_H$27, U-$V_H$28, U-$V_H$29, U-$V_H$30, U-$V_H$31, U-$V_H$32, U-$V_H$33, U-$V_H$34, U-$V_H$35, U-$V_H$36, U-$V_H$37, U-$V_H$38, U-$V_H$39, U-$V_H$40, U-$V_H$41, U-$V_H$42, U-$V_H$43, U-$V_H$44, U-$V_H$45, U-$V_H$46, U-$V_H$47, U-$V_H$48, U-$V_H$49, U-$V_H$50, U-$V_H$51, U-$V_H$52, U-$V_H$53, U-$V_H$54, U-$V_H$55, U-$V_H$56, U-$V_H$57, or U-$V_H$58, etc.

In some instances, the antigen binding protein includes at least one heavy chain variable region and/or one light chain variable region from those listed in FIGS. 1A-1P, and FIGS. 2A-2O, respectively. In some instances, the antigen binding protein includes at least two different heavy chain variable regions and/or light chain variable regions from those listed in FIGS. 1A-1P, and FIGS. 2A-2O, respectively. An example of such an antigen binding protein comprises (a) one U-$V_L$1, and (b) one of U-$V_L$2, U-$V_L$3, U-$V_L$4, U-$V_L$5, U-$V_L$6, U-$V_L$7, U-$V_L$8, U-$V_L$9, U-$V_L$10, U-$V_L$11, U-$V_L$12, U-$V_L$13, U-$V_L$14, U-$V_L$15, U-$V_L$16, U-$V_L$17, U-$V_L$18, U-$V_L$19, U-$V_L$20, U-$V_L$21, U-$V_L$22, U-$V_L$23, U-$V_L$24, U-$V_L$25, U-$V_L$26, U-$V_L$27, U-$V_L$28, U-$V_L$29, U-$V_L$30, U-$V_L$31, U-$V_L$32, U-$V_L$33, U-$V_L$34, U-$V_L$35, U-$V_L$36, U-$V_L$37, U-$V_L$38, U-$V_L$39, U-$V_L$40, U-$V_L$41, U-$V_L$42, U-$V_L$43, U-$V_L$44, U-$V_L$45, U-$V_L$46, U-$V_L$47, U-$V_L$48, U-$V_L$49, U-$V_L$50, U-$V_L$51, U-$V_L$52, U-$V_L$54, U-$V_L$55, U-$V_L$56, U-$V_L$57, U-$V_L$58, U-$V_L$59, U-$V_L$60, U-$V_L$61, U-$V_L$62, U-$V_L$64, and U-$V_L$65. Again another example of such an antigen binding protein comprises (a) one U-$V_L$2, and (b) one of U-$V_L$1, U-$V_L$3, U-$V_L$4, U-$V_L$5, U-$V_L$6, U-$V_L$7, U-$V_L$8, U-$V_L$9, U-$V_L$10, U-$V_L$11, U-$V_L$12, U-$V_L$13, U-$V_L$14, U-$V_L$15, U-$V_L$16, U-$V_L$17, U-$V_L$18, U-$V_L$19, U-$V_L$20, U-$V_L$21, U-$V_L$22, U-$V_L$23, U-$V_L$24, U-$V_L$25, U-$V_L$26, U-$V_L$27, U-$V_L$28, U-$V_L$29, U-$V_L$30, U-$V_L$31, U-$V_L$32, U-$V_L$33, U-$V_L$34, U-$V_L$35, U-$V_L$36, U-$V_L$37, U-$V_L$38, U-$V_L$39, U-$V_L$40, U-$V_L$41, U-$V_L$42, U-$V_L$43, U-$V_L$44, U-$V_L$45, U-$V_L$46, U-$V_L$47, U-$V_L$48, U-$V_L$49, U-$V_L$50, U-$V_L$51, U-$V_L$52, U-$V_L$54, U-$V_L$55, U-$V_L$56, U-$V_L$57, U-$V_L$58, U-$V_L$59, U-$V_L$60, U-$V_L$61, U-$V_L$62, U-$V_L$64, and U-$V_L$65. Again another example of such an antigen binding protein comprises (a) one U-$V_L$3, and (b) one of U-$V_L$1, U-$V_L$2, U-$V_L$4, U-$V_L$5, U-$V_L$6, U-$V_L$7, U-$V_L$8, U-$V_L$9, U-$V_L$10, U-$V_L$11, U-$V_L$12, U-$V_L$13, U-$V_L$14, U-$V_L$15, U-$V_L$16, U-$V_L$17, U-$V_L$18, U-$V_L$19, U-$V_L$20, U-$V_L$21, U-$V_L$22, U-$V_L$23, U-$V_L$24, U-$V_L$25, U-$V_L$26, U-$V_L$27, U-$V_L$28, U-$V_L$29, U-$V_L$30, U-$V_L$31, U-$V_L$32, U-$V_L$33, U-$V_L$34, U-$V_L$35, U-$V_L$36, U-$V_L$37, U-$V_L$38, U-$V_L$39, U-$V_L$40, U-$V_L$41, U-$V_L$42, U-$V_L$43, U-$V_L$44, U-$V_L$45, U-$V_L$46, U-$V_L$47, U-$V_L$48, U-$V_L$49, U-$V_L$50, U-$V_L$51, U-V$_L$52, U-V$_L$54, U-V$_L$55, U-V$_L$56, U-V$_L$57, U-V$_L$58, U-V$_L$59, U-V$_L$60, U-V$_L$61, U-V$_L$62, U-V$_L$64, and U-V$_L$65, etc.

Again another example of such an antigen binding protein comprises (a) one U-V$_H$1, and (b) one of U-V$_H$2, U-V$_H$3, U-V$_H$4, U-V$_H$5, U-V$_H$6, U-V$_H$7, U-V$_H$8, U-V$_H$9, U-V$_H$10, U-V$_H$11, U-V$_H$12, U-V$_H$13, U-V$_H$14, U-V$_H$15, U-V$_H$16, U-V$_H$17, U-V$_H$18, U-V$_H$19, U-V$_H$20, U-V$_H$21, U-V$_H$22, U-V$_H$23, U-V$_H$24, U-V$_H$25, U-V$_H$26, U-V$_H$27, U-V$_H$28, U-V$_H$29, U-V$_H$30, U-V$_H$31, U-V$_H$32, U-V$_H$33, U-V$_H$34, U-V$_H$35, U-V$_H$36, U-V$_H$37, U-V$_H$38, U-V$_H$39, U-V$_H$40, U-V$_H$41, U-V$_H$42, U-V$_H$43, U-V$_H$44, U-V$_H$45, U-V$_H$46, U-V$_H$47, U-V$_H$48, U-V$_H$49, U-V$_H$50, U-V$_H$51, U-V$_H$52, U-V$_H$53, U-V$_H$54, U-V$_H$55, U-V$_H$56, U-V$_H$57, and U-V$_H$58. Another example comprises (a) one U-V$_H$2, and (b) one of U-V$_H$1, U-V$_H$3, U-V$_H$4, U-V$_H$5, U-V$_H$6, U-V$_H$7, U-V$_H$8, U-V$_H$9, U-V$_H$10, U-V$_H$11, U-V$_H$12, U-V$_H$13, U-V$_H$14, U-V$_H$15, U-V$_H$16, U-V$_H$17, U-V$_H$18, U-V$_H$19, U-V$_H$20, U-V$_H$21, U-V$_H$22, U-V$_H$23, U-V$_H$24, U-V$_H$25, U-V$_H$26, U-V$_H$27, U-V$_H$28, U-V$_H$29, U-V$_H$30, U-V$_H$31, U-V$_H$32, U-V$_H$33, U-V$_H$34, U-V$_H$35, U-V$_H$36, U-V$_H$37, U-V$_H$38, U-V$_H$39, U-V$_H$40, U-V$_H$41, U-V$_H$42, U-V$_H$43, U-V$_H$44, U-V$_H$45, U-V$_H$46, U-V$_H$47, U-V$_H$48, U-V$_H$49, U-V$_H$50, U-V$_H$51, U-V$_H$52, U-V$_H$53, U-V$_H$54, U-V$_H$55, U-V$_H$56, U-V$_H$57, and U-V$_H$58. Again another example comprises (a) one U-V$_H$3, and (b) one of U-V$_H$1, U-V$_H$2, U-V$_H$4, U-V$_H$5, U-V$_H$6, U-V$_H$7, U-V$_H$8, U-V$_H$9, U-V$_H$10, U-V$_H$11, U-V$_H$12, U-V$_H$13, U-V$_H$14, U-V$_H$15, U-V$_H$16, U-V$_H$17, U-V$_H$18, U-V$_H$19, U-V$_H$20, U-V$_H$21, U-V$_H$22, U-V$_H$23, U-V$_H$24, U-V$_H$25, U-V$_H$26, U-V$_H$27, U-V$_H$28, U-V$_H$29, U-V$_H$30, U-V$_H$31, U-V$_H$32, U-V$_H$33, U-V$_H$34, U-V$_H$35, U-V$_H$36, U-V$_H$37, U-V$_H$38, U-V$_H$39, U-V$_H$40, U-V$_H$41, U-V$_H$42, U-V$_H$43, U-V$_H$44, U-V$_H$45, U-V$_H$46, U-V$_H$47, U-V$_H$48, U-V$_H$49, U-V$_H$50, U-V$_H$51, U-V$_H$52, U-V$_H$53, U-V$_H$54, U-V$_H$55, U-V$_H$56, U-V$_H$57, and U-V$_H$58, etc.

The various combinations of heavy chain variable regions may be combined with any of the various combinations of light chain variable regions.

In other instances, the antigen binding protein contains two identical light chain variable regions and/or two identical heavy chain variable regions. As an example, the antigen binding protein may be an antibody or immunologically functional fragment that includes two light chain variable regions and two heavy chain variable regions in combinations of pairs of light chain variable regions and pairs of heavy chain variable regions as listed in FIGS. 1A-1P, and FIGS. 2A-2O, respectively.

Some antigen binding proteins that are provided comprise a light chain variable domain comprising a sequence of amino acids that differs from the sequence of a light chain variable domain selected from U-V$_L$1, U-V$_L$2, U-V$_L$3, U-V$_L$4, U-V$_L$5, U-V$_L$6, U-V$_L$7, U-V$_L$8, U-V$_L$9, U-V$_L$10, U-V$_L$11, U-V$_L$12, U-V$_L$13, U-V$_L$14, U-V$_L$15, U-V$_L$16, U-V$_L$17, U-V$_L$18, U-V$_L$19, U-V$_L$20, U-V$_L$21, U-V$_L$22, U-V$_L$23, U-V$_L$24, U-V$_L$25, U-V$_L$26, U-V$_L$27, U-V$_L$28, U-V$_L$30, U-V$_L$31, U-V$_L$32, U-V$_L$33, U-V$_L$34, U-V$_L$35, U-V$_L$36, U-V$_L$37, U-V$_L$38, U-V$_L$39, U-V$_L$40, U-V$_L$41, U-V$_L$42, U-V$_L$43, U-V$_L$44, U-V$_L$45, U-V$_L$46, U-V$_L$47, U-V$_L$48, U-V$_L$49, U-V$_L$50, U-V$_L$51, U-V$_L$52, U-V$_L$54, U-V$_L$55, U-V$_L$56, U-V$_L$57, U-V$_L$58, U-V$_L$59, U-V$_L$60, U-V$_L$61, U-V$_L$62, U-V$_L$64, or U-V$_L$65 at only 1, 2, 3, 4, 5, 6, 7, 8, 9, 10, 11, 12, 13, 14 or 15 amino acid residues, wherein each such sequence difference is independently either a deletion, insertion or substitution of one amino acid. The light chain variable region in some antigen binding proteins comprises a sequence of amino acids that has at least 70%, 75%, 80%, 85%, 90%, 95%, 97% or 99% sequence identity to the amino acid sequences of the light chain variable region of U-V$_L$1, U-V$_L$2, U-V$_L$3, U-V$_L$4, U-V$_L$5, U-V$_L$6, U-V$_L$7, U-V$_L$8, U-V$_L$9, U-V$_L$10, U-V$_L$11, U-V$_L$12, U-V$_L$13, U-V$_L$14, U-V$_L$15, U-V$_L$16, U-V$_L$17, U-V$_L$18, U-V$_L$19, U-V$_L$20, U-V$_L$21, U-V$_L$22, U-V$_L$23, U-V$_L$24, U-V$_L$25, U-V$_L$26, U-V$_L$27, U-V$_L$28, U-V$_L$29, U-V$_L$30, U-V$_L$31, U-V$_L$32, U-V$_L$33, U-V$_L$34, U-V$_L$35, U-V$_L$36, U-V$_L$37, U-V$_L$38, U-V$_L$39, U-V$_L$40, U-V$_L$41, U-V$_L$42, U-V$_L$43, U-V$_L$44, U-V$_L$45, U-V$_L$46, U-V$_L$47, U-V$_L$48, U-V$_L$49, U-V$_L$50, U-V$_L$51, U-V$_L$52, U-V$_L$54, U-V$_L$55, U-V$_L$57, U-V$_L$58, U-V$_L$59, U-V$_L$60, U-V$_L$61, U-V$_L$62, U-V$_L$64, or U-V$_L$65.

Certain antibodies comprise a heavy chain variable domain comprising a sequence of amino acids that differs from the sequence of a heavy chain variable domain selected from U-V$_H$1, U-V$_H$2, U-V$_H$3, U-V$_H$4, U-V$_H$5, U-V$_H$6, U-V$_H$7, U-V$_H$8, U-V$_H$9, U-V$_H$10, U-V$_H$11, U-V$_H$12, U-V$_H$13, U-V$_H$14, U-V$_H$15, U-V$_H$16, U-V$_H$17, U-V$_H$18, U-V$_H$19, U-V$_H$20, U-V$_H$21, U-V$_H$22, U-V$_H$23, U-V$_H$24, U-V$_H$25, U-V$_H$26, U-V$_H$27, U-V$_H$28, U-V$_H$29, U-V$_H$30, U-V$_H$31, U-V$_H$32, U-V$_H$33, U-V$_H$34, U-V$_H$35, U-V$_H$36, U-V$_H$37, U-V$_H$38, U-V$_H$39, U-V$_H$40, U-V$_H$41, U-V$_H$42, U-V$_H$43, U-V$_H$44, U-V$_H$45, U-V$_H$46, U-V$_H$47, U-V$_H$48, U-V$_H$49, U-V$_H$50, U-V$_H$51, U-V$_H$52, U-V$_H$53, U-V$_H$54, U-V$_H$55, U-V$_H$56, U-V$_H$57, or U-V$_H$58 at only 1, 2, 3, 4, 5, 6, 7, 8, 9, 10, 11, 12, 13, 14 or 15 amino acid residues, wherein each such sequence difference is independently either a deletion, insertion or substitution of one amino acid. The heavy chain variable region in some antigen binding proteins comprises a sequence of amino acids that has at least 70%, 75%, 80%, 85%, 90%, 95%, 97% or 99% sequence identity to the amino acid sequences of the heavy chain variable region of U-V$_H$1, U-V$_H$2, U-V$_H$3, U-V$_H$4, U-V$_H$5, U-V$_H$6, U-V$_H$7, U-V$_H$8, U-V$_H$9, U-V$_H$10, U-V$_H$11, U-V$_H$12, U-V$_H$13, U-V$_H$14, U-V$_H$15, U-V$_H$16, U-V$_H$17, U-V$_H$18, U-V$_H$19, U-V$_H$20, U-V$_H$21, U-V$_H$22, U-V$_H$23, U-V$_H$24, U-V$_H$25, U-V$_H$26, U-V$_H$27, U-V$_H$28, U-V$_H$29, U-V$_H$30, U-V$_H$31, U-V$_H$32, U-V$_H$33, U-V$_H$34, U-V$_H$35, U-V$_H$36, U-V$_H$37, U-V$_H$38, U-V$_H$39, U-V$_H$40, U-V$_H$41, U-V$_H$42, U-V$_H$43, U-V$_H$44, U-V$_H$45, U-V$_H$46, U-V$_H$47, U-V$_H$48, U-V$_H$49, U-V$_H$50, U-V$_H$51, U-V$_H$52, U-V$_H$53, U-V$_H$54, U-V$_H$55, U-V$_H$56, U-V$_H$57, or U-V$_H$58.

Still other antigen binding proteins, e.g., antibodies or immunologically functional fragments include variant forms of a variant light chain and a variant heavy chain as just described.

3. CDRs

The antigen binding proteins disclosed herein are polypeptides into which one or more CDRs are grafted, inserted and/or joined. An antigen binding protein can have 1, 2, 3, 4, 5 or 6 CDRs. An antigen binding protein thus can have, for example, one light chain CDR1 ("CDRL1"), and/or one light chain CDR2 ("CDRL2"), and/or one light chain CDR3 ("CDRL3"), and/or one heavy chain CDR1 ("CDRH1"), and/or one heavy chain CDR2 ("CDRH2"), and/or one heavy chain CDR3 ("CDRH3"). Some antigen binding proteins include both a CDRL3 and a CDRH3. Specific CDRs are identified in FIGS. 6A-6F, and FIGS. 7A-7E.

Complementarity determining regions (CDRs) and framework regions (FR) (examples of light and heavy chain FR amino acid sequences are given in FIGS. 8A-8H and FIGS. 9A-9F, respectively) of a given antibody may be identified using the system described by Kabat et al. in Sequences of Proteins of Immunological Interest, 5th Ed., US Dept. of Health and Human Services, PHS, NIH, NIH Publication No. 91-3242, 1991. Certain antibodies that are disclosed herein comprise one or more amino acid sequences that are identical or have substantial sequence identity to the amino acid sequences of one or more of the CDRs presented in FIGS. 6A-6F (CDRLs) and FIGS. 7A-7E (CDRHs).

The structure and properties of CDRs within a naturally occurring antibody has been described, supra. Briefly, in a traditional antibody, the CDRs are embedded within a framework in the heavy and light chain variable region where they constitute the regions responsible for antigen binding and recognition. A variable region comprises at least three heavy or light chain CDRs, see, supra (Kabat et al., 1991, *Sequences of Proteins of Immunological Interest*, Public Health Service N.I.H., Bethesda, Md.; see, also Chothia and Lesk, 1987, *J. Mol. Biol.* 196:901-917; Chothia et al., 1989, *Nature* 342: 877-883), within a framework region (designated framework regions 1-4, FR1, FR2, FR3, and FR4, by Kabat et al., 1991, supra; see, also Chothia and Lesk, 1987, supra). The CDRs provided herein, however, may not only be used to define the antigen binding domain of a traditional antibody structure, but may be embedded in a variety of other polypeptide structures, as described herein.

In one aspect, the CDRs provided are a (a) a CDRL selected from the group consisting of (i) a CDRL1 selected from the group consisting of SEQ ID NOs:189-217; (ii) a CDRL2 selected from the group consisting of SEQ ID NO:218-233; (iii) a CDRL3 selected from the group consisting of SEQ ID NO:234-274; and (iv) a CDRL of (i), (ii) and (iii) that contains one or more amino acid substitutions, deletions or insertions of no more than five, four, three, two, or one amino acids; (B) a CDRH selected from the group consisting of (i) a CDRH1 selected from the group consisting of SEQ ID NO:275-299; (ii) a CDRH2 selected from the group consisting of SEQ ID NO:300-331; (iii) a CDRH3 selected from the group consisting of SEQ ID NO:332-372; and (iv) a CDRLH of (i), (ii) and (iii) that contains one or more amino acid substitutions, deletions or insertions of no more than five, four, three, two, or one amino acids amino acids.

In yet another aspect, variant forms of the CDRs are provided that have at least 80%, 85%, 90% or 95% sequence identity to a CDR sequence listed in FIGS. 6A-6F and FIGS. 7A-7E.

In yet another aspect, the CDRs disclosed herein include consensus sequences derived from groups of related monoclonal antibodies. As described herein, a "consensus sequence" refers to amino acid sequences having conserved amino acids common among a number of sequences and variable amino acids that vary within a given amino acid sequences. The CDR consensus sequences provided include CDRs corresponding to each of CDRL1, CDRL2, CDRL3, CDRH1, CDRH2 and CDRH3.

Figure 12B:
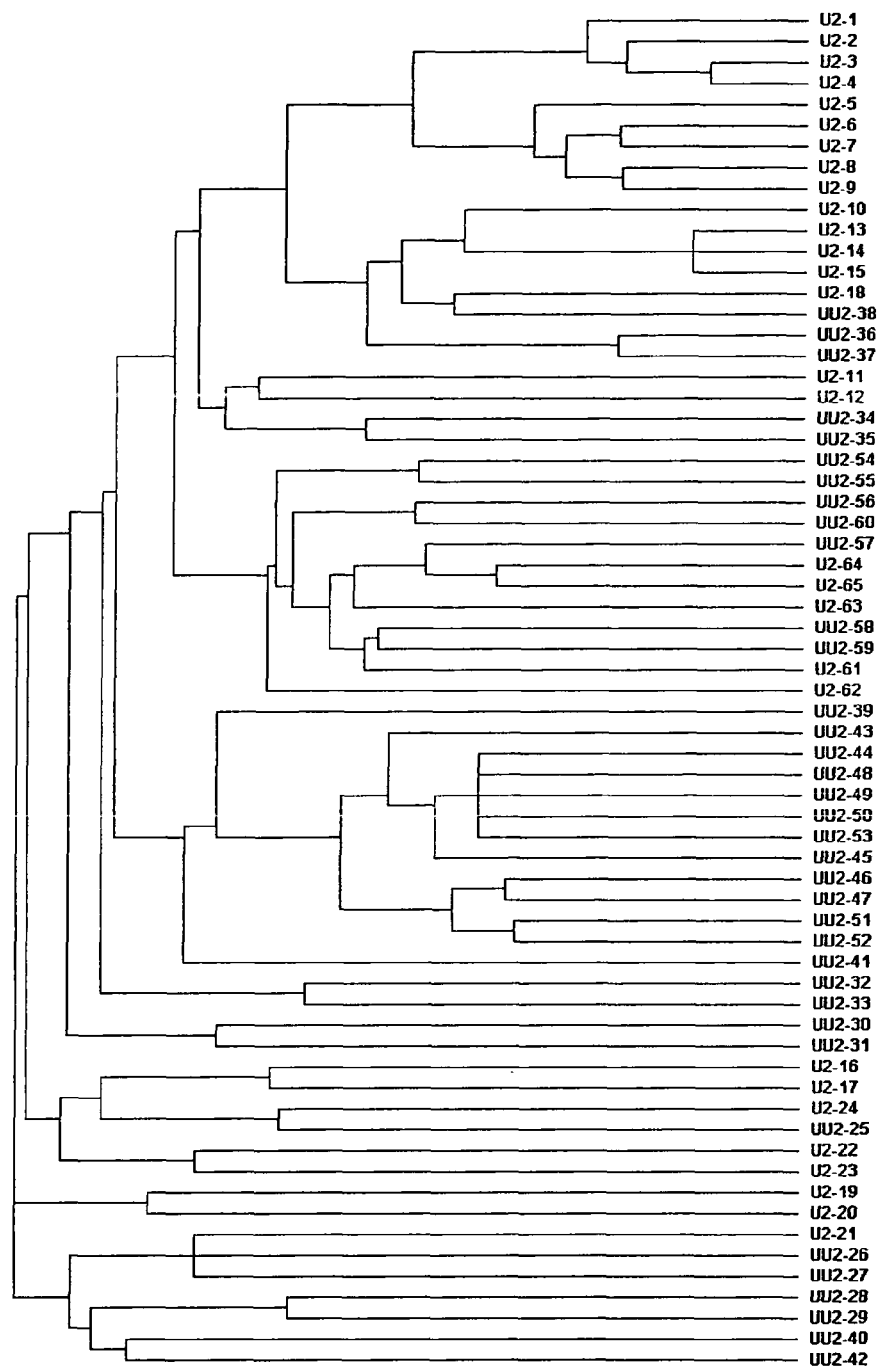
FIG. 12B depicts a cladogram showing the relatedness of the light chain CDRL3 regions of the antigen binding proteins.
Figure 12C:
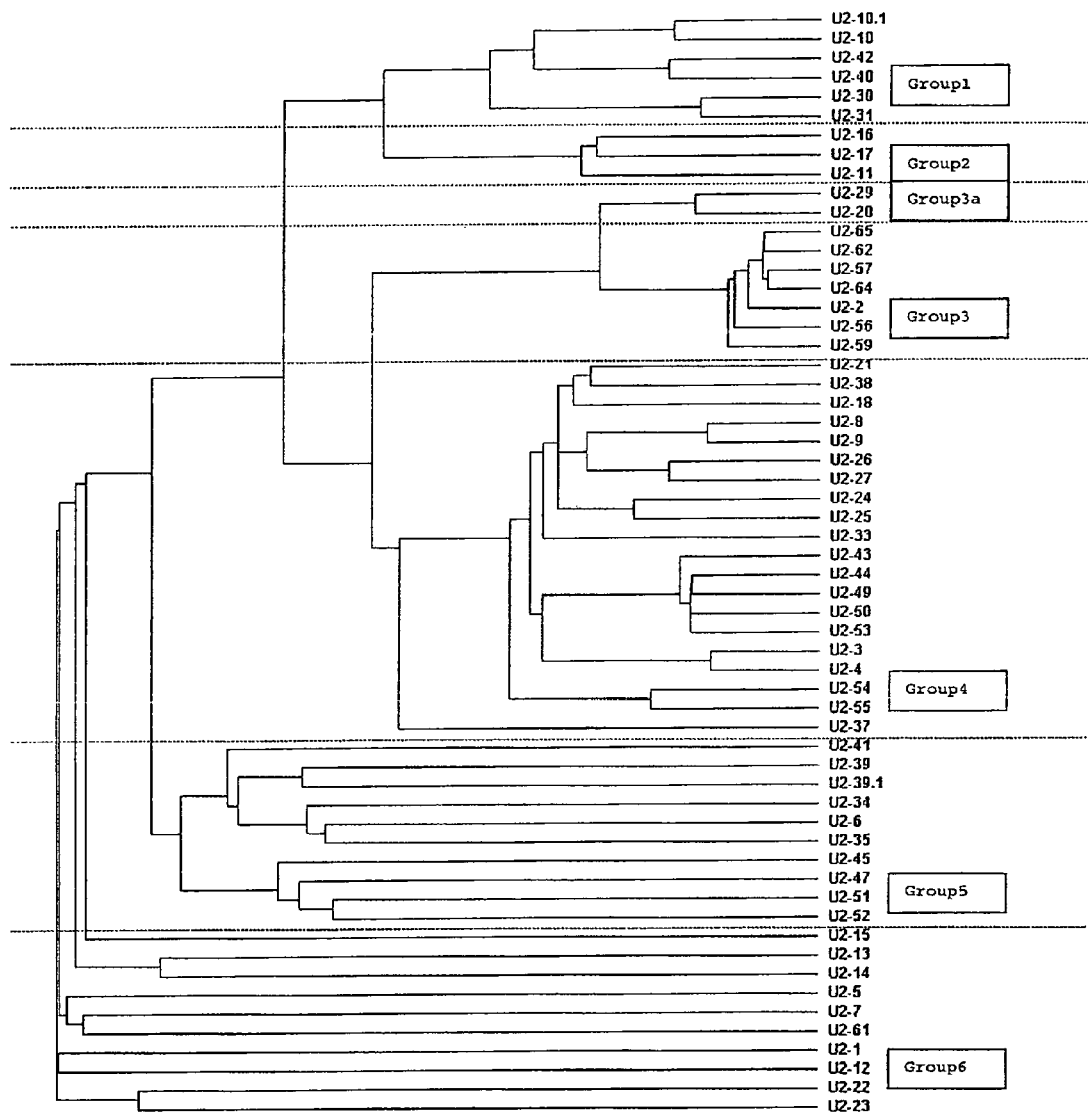
FIG. 12C depicts a cladogram showing the relatedness of the heavy chain variable regions of the antigen binding proteins.
Figure 22A:
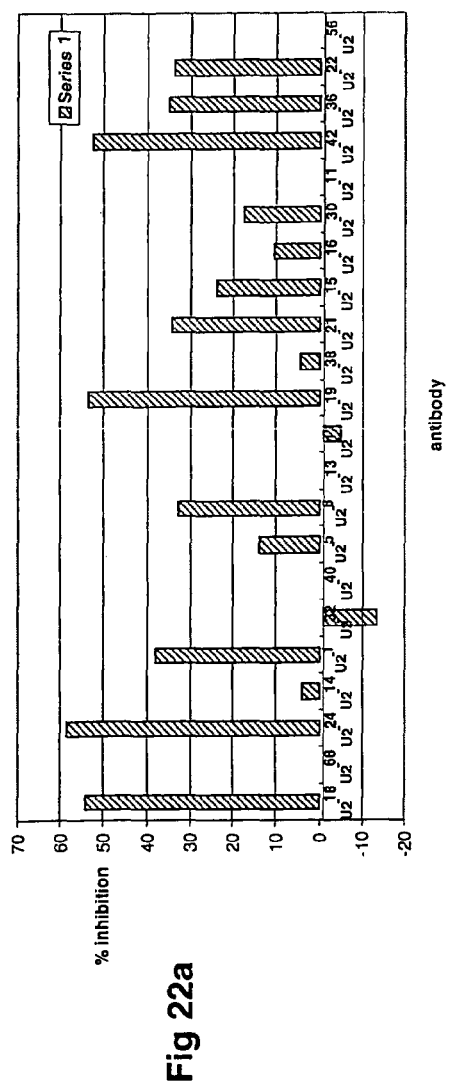
FIG. 22A graphically illustrates the degree to which different anti-HB-EGF IgG2 antibody preparations provided herein inhibit HB-EGF-induced epidermal growth factor receptor (EGFR) tyrosine phosphorylation. The results for preparations of antibodies U2-1 to U2-68 are provided. As illustrated, monoclonal antibody preparations U2-18, U2-24, U2-19 and U2-42 strongly inhibit EGFR tyrosine phosphorylation.
Figure 22B:
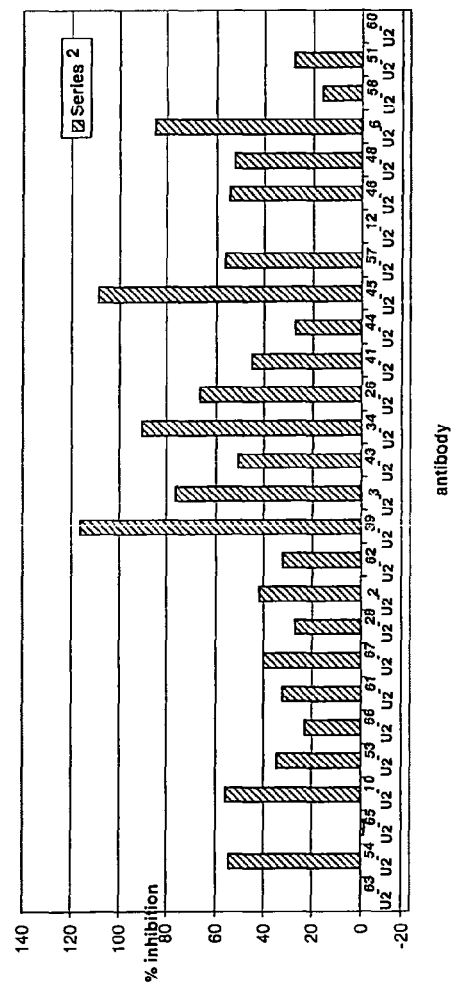
FIG. 22B graphically illustrates the degree to which different anti-HB-EGF IgG4 antibody preparations provided herein inhibit HB-EGF-induced epidermal growth factor receptor (EGFR) tyrosine phosphorylation. The results for preparations of antibodies U2-2 to U2-66 are provided. As illustrated, monoclonal antibody preparations U2-39, U2-34, U2-45 and U2-6 strongly inhibit EGFR tyrosine phosphorylation.
Figure 23:
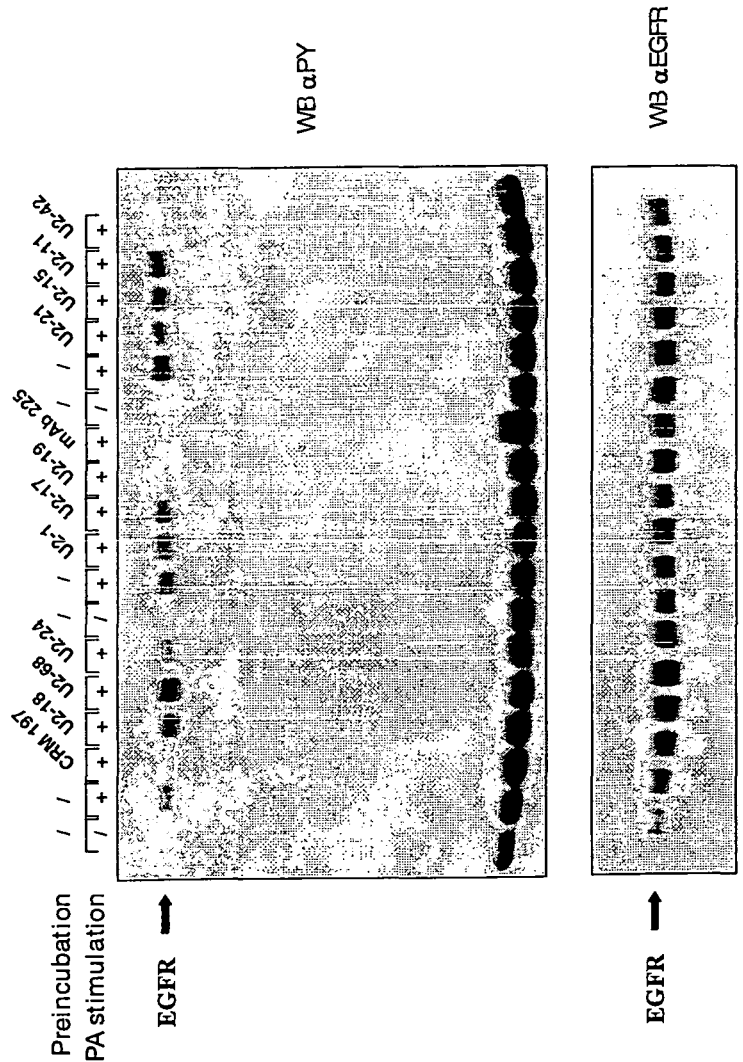
FIG. 23 illustrates that the antibodies inhibit lysophosphatidic acid (LPA)-induced EGFR tyrosine phosphorylation in COS-7 cells. LPA is a GPCR ligand that activates the TMPS pathway, resulting in release of HB-EGF with consequent EGFR tyrosine phosphorylation. COS-7 cells were pretreated with antibodies as indicated and stimulated with LPA, then cell lysates were prepared and lysate proteins were separated by polyacrylamide gel electrophoresis. After preparation of the blot, an anti-phosphotyrosine antibody was used to detect phosphorylated EGFR. As a control, total EGFR was detected as shown at the bottom, using a WB anti-EGFR antibody. As illustrated, anti-HB-EGF antibody preparations U2-24, U2-19 and U2-42 strongly inhibit LPA-induced EGFR phosphorylation.

Consensus sequences were determined using a standard phylogenic analysis approach of the CDRs corresponding to the U-$V_L$ and U-$V_H$ of anti-HB-EGF antibodies. First, in this approach, amino acid sequences corresponding to the entire variable domains of either U-$V_L$ or U-$V_H$ were converted to FASTA formatting for ease in processing comparative alignments and inferring phylogenies. Based on this comparison, each the light and heavy chain variable regions, respectively were divided in phylogenetically related groups, i.e., the light chain variable regions were divided into six groups A, B, C, D, E, and F (see, FIGS. 12A and 12B), and the heavy chain variable regions were divided into seven groups A, B, C, D, E, F, and G (see, FIG. 12C). Then, within each of these groups, comparison of each of the CDRL1, CDRL2, CDRL3, CDRH1, CDRH2, CDRH3 regions was used to define consensus collections.

Group A of the light chain CDRs includes the following consensus collections:

a. a CDRL1 of the generic formula $X_1SSQSLX_2X_3SDGX_4TYLX_5$ (SEQ ID NO:1035), wherein
 $X_1$ is K or R,
 $X_2$ is L or V,
 $X_3$ is H or Y,
 $X_4$ is K or N,
 $X_5$ is N, S or Y.

b. a CDRL2 of the generic formula $X_1X_2SNX_3X_4S$ (SEQ ID NO:1041), wherein
 $X_1$ is E or K,
 $X_2$ is I or V,
 $X_3$ is R or W,
 $X_4$ is D or F.

c. a CDRL3 of the generic formula $X_1QX_2X_3X_4X_5PX_6X_7$ (SEQ ID NO:1046), wherein
 $X_1$ is I or M,
 $X_2$ is A, G or S,
 $X_3$ is I or T,
 $X_4$ is H or Q,
 $X_5$ is F, L or W,
 $X_6$ is C, I, H, L or T,
 $X_7$ is S or T.

Group B of the light chain CDRs includes the following consensus collections:

a. a CDRL1 of the generic formula $RASQX_1ISX_2YLN$ (SEQ ID NO:1036), wherein
 $X_1$ is R, S or T,
 $X_2$ is R or S.

b. a CDRL2 of the generic formula $X_1X_2SX_3LQS$ (SEQ ID NO:1042), wherein
 $X_1$ is A or T,
 $X_2$ is A, E or V,
 $X_3$ is S or T.

c. a CDRL3 of the generic formula $QQX_1X_2X_3X_4X_5IT$ (SEQ ID NO:1047), wherein
 $X_1$ is I or S,
 $X_2$ is F or Y,
 $X_3$ is F, I, S or Y,
 $X_4$ is A, S or T,
 $X_5$ is P or S.

Group C of the light chain CDRs includes the following consensus collections:

a. a CDRL1 of the generic formula $RASQX_1IX_2X_3X_4LX_5$ (SEQ ID NO:1037), wherein
 $X_1$ is D, G, S or T,
 $X_2$ is A, R or S,
 $X_3$ is H, I, N, R, S or T,
 $X_4$ is D, W or Y,
 $X_5$ is A, G or N.

b. a CDRL2 of the generic formula $X_1ASX_2LQS$ (SEQ ID NO:1043), wherein
 $X_1$ is A or V,
 $X_2$ is S or T.

c. a CDRL3 of the generic formula $X_1X_2X_3X_4X_5X_6X_7X_8T$ (SEQ ID NO:1048), wherein
 $X_1$ is L or Q,
 $X_2$ is K, N or Q,
 $X_3$ is A, H, S or Y,
 $X_4$ is H, N or Y,
 $X_5$ is N, S or T,
 $X_6$ is A, F, I, T, V or Y,
 $X_7$ is P or no amino acid,
 $X_8$ is F, L or P.

Group D of the light chain CDRs includes the following consensus collections:

a. a CDRL1 of the generic formula QASQDIX$_1$X$_2$X$_3$LN (SEQ ID NO:1038), wherein
X$_1$ is S or T,
X$_2$ is D or N,
X$_3$ is S or Y.
b. a CDRL2 of the generic formula DASX$_1$LET (SEQ ID NO:1044), wherein
X$_1$ is I or N.
c. a CDRL3 of the generic formula QX$_1$X$_2$DX$_3$LPX$_4$X$_5$ (SEQ ID NO:1049), wherein
X$_1$ is H or Q,
X$_2$ is C or Y,
X$_3$ is D, I, N, S or Y,
X$_4$ is F, I or L,
X$_5$ is A, S or T.

Group E of the light chain CDRs includes the following consensus collections:

a. a CDRL1 of the generic formula RASQX$_1$VX$_2$X$_3$X$_4$X$_5$LA (SEQ ID NO:1039), wherein
X$_1$ is S or T,
X$_2$ is I or S,
X$_3$ is R or S,
X$_4$ is S, N or no amino acid,
X$_5$ is Y or no amino acid.
b. a CDRL2 of the generic formula GASSRAT (SEQ ID NO:223)
c. a CDRL3 of the generic formula QQX$_1$X$_2$X$_3$X$_4$PX$_5$X$_6$X$_7$ (SEQ ID NO:1050), wherein
X$_1$ is H or Y,
X$_2$ is G or N,
X$_3$ is N or S,
X$_4$ is S or W,
X$_5$ is P or no amino acid,
X$_6$ is R or W,
X$_7$ is S or T.

Group F of the light chain CDRs includes the following consensus collections:

a. a CDRL1 of the generic formula KSSQX$_1$X$_2$LX$_3$X$_4$SNNKNYLX$_5$ (SEQ ID NO:1040), wherein
X$_1$ is N or S,
X$_2$ is I or V,
X$_3$ is D or Y,
X$_4$ is N, R or S,
X$_5$ is A or V.
b. a CDRL2 of the generic formula WASX$_1$RES (SEQ ID NO:1045), wherein
X$_1$ is A or T.
c. a CDRL3 of the generic formula X$_1$QYX$_2$X$_3$X$_4$X$_5$X$_6$X$_7$F (SEQ ID NO:1051), wherein
X$_1$ is H or Q,
X$_2$ is F or Y,
X$_3$ is G, I or S,
X$_4$ is F, I or T,
X$_5$ is M, P, S or T,
X$_6$ is F, L, R or W,
X$_7$ is S or T Group A of the heavy chain CDRs includes the following consensus collections:

a. a CDRH1 of the generic formula GYTX$_1$TX$_2$X$_3$X$_4$X$_5$X$_6$ (SEQ ID NO:1052), wherein
X$_1$ is F or L,
X$_2$ is E, G or S,
X$_3$ is H, L or Y,
X$_4$ is G, S or Y,
X$_5$ is I or M,
X$_6$ is H or S.
b. a CDRH2 of the generic formula X$_1$X$_2$X$_3$X$_4$X$_5$X$_6$GX$_7$TX$_8$X$_9$X$_{10}$QKX$_{11}$X$_{12}$ (SEQ ID NO:1058), wherein
X$_1$ is S or W,
X$_2$ is F or I,
X$_3$ is D, N or S,
X$_4$ is A, P,
X$_5$ is E, N or S,
X$_6$ is D, N or S,
X$_7$ is E, G or N,
X$_8$ is I or N,
X$_9$ is C, H or Y,
X$_{10}$ is A or T,
X$_{11}$ is F or L,
X$_{12}$ is D or G.
c. a CDRH3 of the generic formula X$_1$X$_2$X$_3$X$_4$X$_5$X$_6$X$_7$X$_8$X$_9$X$_{10}$X$_{11}$DX$_{12}$ (SEQ ID NO:1065), wherein
X$_1$ is E or S,
X$_2$ is D, G or no amino acid,
X$_3$ is D, N or no amino acid,
X$_4$ is G or no amino acid,
X$_5$ is G or no amino acid,
X$_6$ is W, Y or no amino acid,
X$_7$ is I, N or Y,
X$_8$ is A or Y,
X$_9$ is G, V or Y,
X$_{10}$ is A, F or G,
X$_{11}$ is F, L or M,
X$_{12}$ is V or Y.

Group B of the heavy chain CDRs includes the following consensus collections:

a. a CDRH1 of the generic formula GYX$_1$FTSYWIG (SEQ ID NO:1053), wherein
X$_1$ is R or S.
b. a CDRH2 of the generic formula IIYPX$_1$DSDX$_2$RYSPSFQG (SEQ ID NO:1059), wherein
X$_1$ is D or G,
X$_2$ is A, I or T.
c. a CDRH3 of the generic formula QX$_1$X$_2$X$_3$X$_4$X$_5$X$_6$X$_7$X$_8$X$_9$X$_{10}$X$_{11}$YX$_{12}$X$_{13}$X$_{14}$DX$_{15}$ (SEQ ID NO:1066), wherein
X$_1$ is G or no amino acid,
X$_2$ is K, L or Y,
X$_3$ is A, G or S,
X$_4$ is S, V or Y,
X$_5$ is A or G,
X$_6$ is G or no amino acid,
X$_7$ is T or no amino acid,
X$_8$ is S or no amino acid,
X$_9$ is Y or no amino acid,
X$_{10}$ is W or Y,
X$_{11}$ is G, S or Y,
X$_{12}$ is F or Y,
X$_{13}$ is G or no amino acid,
X$_{14}$ is M or no amino acid,
X$_{15}$ is V or Y.

Group C of the heavy chain CDRs includes the following consensus collections:

a. a CDRH1 of the generic formula GFTFX$_1$SX$_2$X$_3$MH (SEQ ID NO:1054), wherein
X$_1$ is R or S,
X$_2$ is H or Y,
X$_3$ is D or G.

b. a CDRH2 of the generic formula $X_1IX_2X_3DGSX_4X_5X_6YX_7DSVX_8G$ (SEQ ID NO:1060), wherein
  $X_1$ is F or V,
  $X_2$ is S or W,
  $X_3$ is D, S or Y,
  $X_4$ is I, N or T,
  $X_5$ is K or Q,
  $X_6$ is N, R or Y,
  $X_7$ is A, T or V,
  $X_8$ is K or R.
 c. a CDRH3 of the generic formula $X_1X_2X_3X_4X_5X_6X_7X_8X_9X_{10}X_{11}X_{12}X_{13}X_{14}$ (SEQ ID NO:1067), wherein
  $X_1$ is D, G, L, S or no amino acid,
  $X_2$ is G, H, W, Y or no amino acid,
  $X_3$ is A, F, W, Y or no amino acid,
  $X_4$ is D, G, Q, T or no amino acid,
  $X_5$ is G, I, Q, S or no amino acid,
  $X_6$ is A, D, N, Q, S or no amino acid,
  $X_7$ is G, Y or no amino acid,
  $X_8$ is D, Y or no amino acid,
  $X_9$ is Y or no amino acid,
  $X_{10}$ is A, E, N or Y,
  $X_{11}$ is G, P, T, V or Y,
  $X_{12}$ is F or I,
  $X_{13}$ is D or Q,
  $X_{14}$ is C, H, V or Y.

Group D of the heavy chain CDRs includes the following consensus collections:
 a. a CDRH1 of the generic formula $GFX_1FSX_2YX_3MX_4$ (SEQ ID NO:1055), wherein
  $X_1$ is P or T,
  $X_2$ is A, R or S,
  $X_3$ is A or S,
  $X_4$ is N or S.
 b. a CDRH2 of the generic formula $X_1ISX_2SX_3X_4X_5X_6YYADSVKG$ (SEQ ID NO:1061), wherein
  $X_1$ is A, H or Y,
  $X_2$ is G, R or S,
  $X_3$ is G or S,
  $X_4$ is G, R or S,
  $X_5$ is S, T or Y,
  $X_6$ is I or T.
 c. a CDRH3 of the generic formula $X_1X_2X_3X_4X_5X_6X_7X_8X_9X_{10}X_{11}X_{12}X_{13}X_{14}X_{15}X_{16}X_{17}DX_{18}$ (SEQ ID NO:1068), wherein
  $X_1$ is E, D or no amino acid,
  $X_2$ is G, R or no amino acid,
  $X_3$ is I, V, Y or no amino acid,
  $X_4$ is A, G, L or N,
  $X_5$ is A, G, V or W,
  $X_6$ is A, N, R or T,
  $X_7$ is G, N, P or no amino acid,
  $X_8$ is G, T, no amino acid,
  $X_9$ is A or no amino acid,
  $X_{10}$ is D, E or no amino acid,
  $X_{11}$ is S, Y or no amino acid,
  $X_{12}$ is G, Y or no amino acid,
  $X_{13}$ is N, Y or no amino acid,
  $X_{14}$ is Y or no amino acid,
  $X_{15}$ is D, Y or no amino acid,
  $X_{16}$ is A, G or no amino acid,
  $X_{17}$ is F or M,
  $X_{18}$ is I, V or Y.

Group E of the heavy chain CDRs includes the following consensus collections:
 a. a CDRH1 of the generic formula $GX_1SX_2SX_3X_4X_5X_6X_7WX_8$ (SEQ ID NO:1056), wherein
  $X_1$ is D or G,
  $X_2$ is F, I or V,
  $X_3$ is R, S or no amino acid,
  $X_4$ is G, Y or no amino acid,
  $X_5$ is D, G, S or no amino acid,
  $X_6$ is A, S or Y,
  $X_7$ is A or Y,
  $X_8$ is N or S.
 b. a CDRH2 of the generic formula $X_1X_2X_3X_4X_5X_6X_7X_8X_9X_{10}X_{11}YX_{12}X_{13}SX_{14}KS$ (SEQ ID NO:1062), wherein
  $X_1$ is E, R or Y,
  $X_2$ is I or T,
  $X_3$ is H, N or Y,
  $X_4$ is C, H, S, T or Y,
  $X_5$ is S or R,
  $X_6$ is G or S,
  $X_7$ is G, K, S or T,
  $X_8$ is T or W,
  $X_9$ is N or Y,
  $X_{10}$ is N or no amino acid,
  $X_{11}$ is D or no amino acid,
  $X_{12}$ is A or N,
  $X_{13}$ is P or V,
  $X_{14}$ is L or V.
 c. a CDRH3 of the generic formula $X_1X_2X_3X_4X_5X_6X_7X_8X_9X_{10}X_{11}X_{12}X_{13}X_{14}X_{15}X_{16}X_{17}X_{18}X_{19}X_{20}X_{21}X_{22}X_{23}$ (SEQ ID NO:1069), wherein
  $X_1$ is A, D, G, S or T,
  $X_2$ is A, E, G, L, N, R, Y or no amino acid,
  $X_3$ is A, G, L, N, R, T, Y or no amino acid,
  $X_4$ is D, G, R, S, V, Y or no amino acid,
  $X_5$ is A, G, I, S, V, Y or no amino acid,
  $X_6$ is F, G, L, R, V or no amino acid,
  $X_7$ is L, T, Y or no amino acid,
  $X_8$ is Y or no amino acid,
  $X_9$ is Y or no amino acid,
  $X_{10}$ is D or no amino acid,
  $X_{11}$ is S or no amino acid,
  $X_{12}$ is S or no amino acid,
  $X_{13}$ is G or no amino acid,
  $X_{14}$ is D, L, M, S, Y or no amino acid,
  $X_{15}$ is H, I, P, V, W or no amino acid,
  $X_{16}$ is F, G, L, R, S, Y or no amino acid,
  $X_{17}$ is D, F, V, W, Y or no amino acid,
  $X_{18}$ is C, F, L, P, S or Y,
  $X_{19}$ is D, F, G or Y,
  $X_{20}$ is A, C, G, P, R, V or Y,
  $X_{21}$ is F, L, M, S or no amino acid,
  $X_{22}$ is A, D or no amino acid,
  $X_{23}$ is I, L, V, Y or no amino acid.

Group F of the heavy chain CDRs includes the following consensus collections:
 a. a CDRH1 of the generic formula GFSLSNARMGVS (SEQ ID NO:279).
 b. a CDRH2 of the generic formula $X_1IFSNDEKSYSTSLKS$ (SEQ ID NO:1063), wherein
  $X_1$ is H or L.
 c. a CDRH3 of the generic formula $X_1YSSGWX_2X_3YGX_4X_5DX_6$ (SEQ ID NO:1070), wherein
  $X_1$ is M or V,
  $X_2$ is S or no amino acid,
  $X_3$ is F or no amino acid, X₄ is V or no amino acid,
X₅ is F or M,
X₆ is V or Y.

Group G of the heavy chain CDRs includes the following consensus collections:
  a. a CDRH1 of the generic formula GFSLX₁TGGVGVG (SEQ ID NO:1057), wherein
    X₁ is S or N.
  b. a CDRH2 of the generic formula LIYWNX₁X₂KRYSPSLX₃S (SEQ ID NO:1064), wherein
    X₁ is D or V,
    X₂ is D or E,
    X₃ is K or R.
  c. a CDRH3 of the generic formula RX₁X₂X₃PFX₄Y (SEQ ID NO:1071), wherein
    X₁ is G, H, L, N or R,
    X₂ is E, T or W,
    X₃ is L, N, T or V,
    X₄ is D or E.

In another approach, consensus sequences may be determined by keeping the CDRs contiguous within the same sequence corresponding to a U-V$_L$ or U-V$_H$. Briefly, in this approach, amino acid sequences corresponding to the entire variable domains of either U-V$_L$ or U-V$_H$ are converted to FASTA formatting for ease in processing comparative alignments and inferring phylogenies. Next, framework regions of these sequences are replaced with an artificial linker sequence so that examination of the CDRs alone is performed without introducing any amino acid position weighting bias due to coincident events (e.g., such as unrelated antibodies that serendipitously share a common germline framework heritage) whilst still keeping CDRs contiguous within the same sequence corresponding to a U-V$_I$ or U-V$_H$. U-V$_L$ or U-V$_H$ sequences of this format are then subjected to sequence similarity alignment interrogation using a program that employs a standard ClutalW-like algorithm (see, Thompson et al., 1994, *Nucleic Acids Res.* 22:4673-4680). This program likewise generates phylograms (phylogenic tree illustrations) based on sequence similarity alignments using either UPGMA (unweighted pair group method using arithmetic averages) or Neighbor-Joining methods (see, Saitou and Nei, 1987, *Molecular Biology and Evolution* 4:406-425) to construct and illustrate similarity and distinction of sequence groups via branch length comparison and grouping. Both methods produce similar results to determine consensus sequence collections within the individual groups.

In some cases the antigen binding protein comprises at least one CDRL1, CDRL2, or CDRL3 having one of the above consensus sequences. In some cases, the antigen binding protein comprises at least one CDRH1, CDRH2, or CDRH3 having one of the above consensus sequences. In other cases, the antigen binding protein comprises at least two CDRLs according to the above consensus sequences, and/or at least two CDRHs according to the above consensus sequences. In one aspect, the CDRLs and/or CDRHs are derived from different groups. In other cases, the antigen binding protein comprises at least two CDRLs from the same group A, B, C, D, E, or F and/or at least two CDRHs from the same group A, B, C, D, E, F, or G. In other aspects, the antigen binding protein comprises all three CDRL1, CDRL2, and CDRL3 sequences from the same of the above groups A, B, C, D, E, or F, and/or all three CDRH1, CDRH2, and CDRH3 sequence from the same of the above groups A, B, C, D, E, F, or G.

D. Exemplary Antigen Binding Proteins

According to one aspect, an isolated antigen binding protein is provided that binds HB-EGF comprising (A) one or more light chain complementary determining regions (CDRLs) selected from the group consisting of: (i) a CDRL1 selected from the group consisting of SEQ ID NO:189-217; (ii) a CDRL2 selected from the group consisting of SEQ ID NO:218-233; (iii) a CDRL3 selected from the group consisting of SEQ ID NO:234-274; and (iv) a CDRL of (i), (ii) and (iii) that contains one or more amino acid substitutions, deletions or insertions of no more than five, four, three, four, two or one amino acids; (B) one or more heavy chain complementary determining regions (CDRHs) selected from the group consisting of: (i) a CDRH1 selected from the group consisting of SEQ ID NO:275-299; (ii) a CDRH2 selected from the group consisting of SEQ ID NO:300-331; (iii) a CDRH3 selected from the group consisting of SEQ ID NO:332-372; and (iv) a CDRH of (i), (ii) and (iii) that contains one or more amino acid substitutions, deletions or insertions of no more than five, four, three, four, two or one amino acids; or (C) one or more light chain CDRLs of (A); and (D) one or more heavy chain CDRHs of (B).

In yet another embodiment, the isolated antigen binding protein may comprise (A) a CDRL selected from the group consisting of (i) a CDRL1 selected from the group consisting of SEQ ID NO:189-217; (ii) a CDRL2 selected from the group consisting of SEQ ID NO:218-233; and (iii) a CDRL3 selected from the group consisting of SEQ ID NO:234-274; (B) a CDRH selected from the group consisting of (i) a CDRH1 selected from the group consisting of SEQ ID NO:275-299; (ii) a CDRH2 selected from the group consisting of SEQ ID NO:300-331; and (iii) a CDRH3 selected from the group consisting of SEQ ID NO:332-372; or (C) one or more light chain CDRLs of (A); and (D) one or more heavy chain CDRLs of (B). In one embodiment, the isolated antigen binding protein may include (A) a CDRL1 of SEQ ID NO:189-217, a CDRL2 of SEQ ID NO:218-233, and a CDRL3 of SEQ ID NO:234-274, and (B) a CDRH1 of SEQ ID NO:275-299, a CDRH2 of SEQ ID NO:300-331, and a CDRH3 of SEQ ID NO:332-372.

In another embodiment, the antigen binding protein comprises a variable light chain (V$_L$) has at least 80%, 85%, 90% or 95% sequence identity with an amino acid sequence selected from the group consisting of SEQ ID NO:94-141, and/or the variable heavy chain (V$_H$) has at least 80%, 85%, 90% or 95% sequence identity with an amino acid sequence selected from the group consisting of SEQ ID NO:142-186. In a further embodiment, the V$_L$ is selected from the group consisting of SEQ ID NO:94-141, and/or the V$_H$ is selected from the group consisting of SEQ ID NO:142-186.

In another aspect, also provided is an isolated antigen binding protein that specifically binds to an epitope containing at least one IHGE-containing epitope and/or EGF-like epitope of HB-EGF.

In a further aspect, there is a provision of an isolated antigen binding protein that binds HB-EGF, the antigen binding protein including (A) a light chain complementary determining region (CDRL) selected from the group consisting of (i) a CDRL3 selected from the group consisting of SEQ ID NO:234-274, (ii) a CDRL3 that differs in amino acid sequence from the CDRL3 of (i) by an amino acid addition, deletion or substitution of not more than two amino acids; (iii) a CDRL3 amino acid sequence selected from the group consisting of X₁QX₂X₃X₄X₅PX₆X₇ (SEQ ID NO:1046), wherein X₁ is selected from the group consisting of I and M, X₂ is selected from the group consisting of A, G and S, X₃ is selected from the group consisting of I and T, X₄ is selected from the group consisting of H and Q, X₅ is selected from the group consisting of F, L and W, X₆ is selected from the group consisting of C, I, H, L and T, X₇ is selected from the group consisting of S and T; QQX$_1$X$_2$X$_3$X$_4$X$_5$IT (SEQ ID NO:1047), wherein X$_1$ is selected from the group consisting of I and S, X$_2$ is selected from the group consisting of F and Y, X$_3$ is selected from the group consisting of F, I, S and Y, X$_4$ is selected from the group consisting of A, S and T, X$_5$ is selected from the group consisting of P and S; X$_1$X$_2$X$_3$X$_4$X$_5$X$_6$X$_7$X$_8$T (SEQ ID NO:1048), wherein X$_1$ is selected from the group consisting of L and Q, X$_2$ is selected from the group consisting of K, N and Q, X$_3$ is selected from the group consisting of A, H, S and Y, X$_4$ is selected from the group consisting of H, N and Y, X$_5$ is selected from the group consisting of N, S and T, X$_6$ is selected from the group consisting of A, F, I, T, V and Y, X$_7$ is selected from the group consisting of P and no amino acid, X$_8$ is selected from the group consisting of F, L and P; QX$_1$X$_2$DX$_3$LPX$_4$X$_5$ (SEQ ID NO:1049), wherein X$_1$ is selected from the group consisting of H and Q, X$_2$ is selected from the group consisting of C and Y, X$_3$ is selected from the group consisting of D, I, N, S and Y, X$_4$ is selected from the group consisting of F, I and L, X$_5$ is selected from the group consisting of A, S and T; QQX$_1$X$_2$X$_3$X$_4$PX$_5$X$_6$X$_7$ (SEQ ID NO:1050), wherein X$_1$ is selected from the group consisting of H and Y, X$_2$ is selected from the group consisting of G and N, X$_3$ is selected from the group consisting of N and S, X$_4$ is selected from the group consisting of S and W, X$_5$ is selected from the group consisting of P and no amino acid, X$_6$ is selected from the group consisting of R and W, X$_7$ is selected from the group consisting of S and T; and X$_1$QYX$_2$X$_3$X$_4$X$_5$X$_6$X$_7$F (SEQ ID NO:1051), wherein X$_1$ is selected from the group consisting of H and Q, X$_2$ is selected from the group consisting of F and Y, X$_3$ is selected from the group consisting of G, I and S, X$_4$ is selected from the group consisting of F, I and T, X$_5$ is selected from the group consisting of M, P, S and T, X$_6$ is selected from the group consisting of F, L, R and W, X$_7$ is selected from the group consisting of S and T; and/or (B) a heavy chain complementary determining region (CDRH) selected from the group consisting of (i) a CDRH3 selected from the group consisting of SEQ ID NOs:332-372, (ii) a CDRH3 that differs in amino acid sequence from the CDRH3 of (i) by an amino acid addition, deletion or substitution of not more than two amino acids; and (iii) a CDRH3 amino acid sequence selected from the group consisting of X$_1$X$_2$X$_3$X$_4$X$_5$X$_6$X$_7$X$_8$X$_9$X$_{10}$X$_{11}$DX$_{12}$ (SEQ ID NO:1065), wherein X$_1$ is selected from the group consisting of E and S, X$_2$ is selected from the group consisting of D, G and no amino acid, X$_3$ is selected from the group consisting of D, N and no amino acid, X$_4$ is selected from the group consisting of G and no amino acid, X$_5$ is selected from the group consisting of G and no amino acid, X$_6$ is selected from the group consisting of W, Y and no amino acid, X$_7$ is selected from the group consisting of I, N and Y, X$_8$ is selected from the group consisting of A and Y, X$_9$ is selected from the group consisting of G, V and Y, X$_{10}$ is selected from the group consisting of A, F and G, X$_{11}$ is selected from the group consisting of F, L and M, X$_{12}$ is selected from the group consisting of V and Y; QX$_1$X$_2$X$_3$X$_4$X$_5$X$_6$X$_7$X$_8$X$_9$X$_{10}$X$_{11}$YX$_{12}$X$_{13}$X$_{14}$DX$_{15}$ (SEQ ID NO:1066), wherein X$_1$ is selected from the group consisting of G and no amino acid, X$_2$ is selected from the group consisting of K, L and Y, X$_3$ is selected from the group consisting of A, G and S, X$_4$ is selected from the group consisting of S, V and Y, X$_5$ is selected from the group consisting of A and G, X$_6$ is selected from the group consisting of G and no amino acid, X$_7$ is selected from the group consisting of T and no amino acid, X$_8$ is selected from the group consisting of S and no amino acid, X$_9$ is selected from the group consisting of Y and no amino acid, X$_{10}$ is selected from the group consisting of W and Y, X$_{11}$ is selected from the group consisting of G, S and Y, X$_{12}$ is selected from the group consisting of F and Y, X$_{13}$ is selected from the group consisting of G and no amino acid, X$_{14}$ is selected from the group consisting of M and no amino acid, X$_{15}$ is selected from the group consisting of V and Y; X$_1$X$_2$X$_3$X$_4$X$_5$X$_6$X$_7$X$_8$X$_9$X$_{10}$X$_{11}$X$_{12}$X$_{13}$X$_{14}$ (SEQ ID NO:1067), wherein X$_1$ is selected from the group consisting of D, G, L, S and no amino acid, X$_2$ is selected from the group consisting of G, H, W, Y and no amino acid, X$_3$ is selected from the group consisting of A, F, W, Y and no amino acid, X$_4$ is selected from the group consisting of D, G, Q, T and no amino acid, X$_5$ is selected from the group consisting of G, I, Q, S and no amino acid, X$_6$ is selected from the group consisting of A, D, X$_8$ is selected from the group consisting of D, Y and no amino acid, X$_9$ is selected from the group consisting of Y and no amino acid, X$_{10}$ is selected from the group consisting of A, E, N and Y, X$_{11}$ is selected from the group consisting of G, P, T, V and Y, X$_{12}$ is se X$_{14}$ is selected from the group consisting of C, H, V and Y; X$_1$X$_2$X$_3$X$_4$X$_5$X$_6$X$_7$X$_8$X$_9$X$_{10}$X$_{11}$X$_{12}$X$_{13}$X$_{14}$X$_{15}$X$_{16}$X$_{17}$DX$_{18}$ (SEQ ID NO:1068), wherein X$_1$ is selected from the group consisting of E, D and no amino acid, X$_2$ is selected from the group consisting of G, R and no amino acid, X$_3$ is selected from the group consisting of I, V, Y and no amino acid, X$_4$ is selected from the group consisting of A, G, L and N, X$_5$ is selected from the group consisting of A, G, V and W, X$_6$ is selected from the group consisting of A, N, R and T, X$_7$ is selected from the group consisting of G, N, P and no amino acid, X$_8$ is selected from the group consisting of G, T and no amino acid, X$_9$ is selected from the group consisting of A and no amino acid, X$_{10}$ is selected from the group consisting of D, E and no amino acid, X$_{11}$ is selected from the group consisting of S, Y and no amino acid, X$_{12}$ is selected from the group consisting of G, Y and no amino acid, X$_{13}$ is selected from the group consisting of N, Y and no amino acid, X$_{14}$ is selected from the group consisting of Y and no amino acid, X$_{15}$ is selected from the group consisting of D, Y and no amino acid, X$_{16}$ is selected from the group consisting of A, G and no amino acid, X$_{17}$ is selected from the group consisting of F and M, X$_{18}$ is selected from the group consisting of I, V and Y; X$_1$X$_2$X$_3$X$_4$X$_5$X$_6$X$_7$X$_8$X$_9$X$_{10}$X$_{11}$X$_{12}$X$_{13}$X$_{14}$X$_{15}$X$_{16}$X$_{17}$X$_{18}$X$_{19}$X$_{20}$X$_{21}$X$_{22}$X$_{23}$ (SEQ ID NO:1069), wherein X$_1$ is selected from the group consisting of A, D, G, S and T, X$_2$ is selected from the group consisting of A, E, G, L, N, R, Y and no amino acid, X$_3$ is selected from the group consisting of A, G, L, N, R, T, Y and no amino acid, X$_4$ is selected from the group consisting of D, G, R, S, V, Y and no amino acid, X$_5$ is selected from the group consisting of A, G, I, S, V, Y and no amino acid, X$_6$ is selected from the group consisting of F, G, L, R, V and no amino acid, X$_7$ is selected from the group consisting of L, T, Y and no amino acid, X$_8$ is selected from the group consisting of Y and no amino acid, X$_9$ is selected from the group consisting of Y and no amino acid, X$_{10}$ is selected from the group consisting of D and no amino acid, X$_{11}$ is selected from the group consisting of S and no amino acid, X$_{12}$ is selected from the group consisting of S and no amino acid, X$_{13}$ is selected from the group consisting of G and no amino acid, X$_{14}$ is selected from the group consisting of D, L, M, S, Y and no amino acid, X$_{15}$ is selected from the group consisting of H, I, P, V, W and no amino acid, X$_{16}$ is selected from the group consisting of F, G, L, R, S, Y and no amino acid, X$_{17}$ is selected from the group consisting of D, F, V, W, Y and no amino acid, X$_{18}$ is selected from the group consisting of C, F, L, P, S and Y, X$_{19}$ is selected from the group consisting of D, F, G and Y, X$_{20}$ is selected from the group consisting of A, C, G, P, R, V and Y, X$_{21}$ is selected from the group consisting of F, L, M, S and no amino acid, X$_{22}$ is selected from the group consisting of A, D and no amino acid, $X_{23}$ is selected from the group consisting of I, L, V, Y and no amino acid; $X_1YSSGWX_2X_3YGX_4X_5DX_6$ (SEQ ID NO:1070), wherein $X_1$ is selected from the group consisting of M and V, $X_2$ is selected from the group consisting of S and no amino acid, $X_3$ is selected from the group consisting of F and no amino acid, $X_4$ is selected from the group consisting of V and no amino acid, $X_5$ is selected from the group consisting of F and M, $X_6$ is selected from the group consisting of V and Y; and $RX_1X_2X_3PFX_4Y$ (SEQ ID NO:1071), wherein $X_1$ is selected from the group consisting of G, H, L, N and R, $X_2$ is selected from the group consisting of E, T and W, $X_3$ is selected from the group consisting of L, N, T and V, $X_4$ is selected from the group consisting of D and E.

In one embodiment, the isolated antigen binding protein further comprises (A) a CDRL selected from the group consisting of: (i) a CDRL1 selected from the group consisting of SEQ ID NO:189-217; (ii) a CDRL1 that differs in amino acid sequence from the CDRL1 of (i) by an amino acid addition, deletion or substitution of not more than two amino acids; (iii) a CDRL1 amino acid sequence selected from the group consisting of $X_1SSQSLX_2X_3SDGX_4TYLX_5$ (SEQ ID NO:1035), wherein $X_1$ is selected from the group consisting of K and R, $X_2$ is selected from the group consisting of L and V, $X_3$ is selected from the group consisting of H and Y, $X_4$ is selected from the group consisting of K and N, $X_5$ is selected from the group consisting of N, S and Y; $RASQX_1ISX_2YLN$ (SEQ ID NO:1036), wherein $X_1$ is selected from the group consisting of R, S and T, $X_2$ is selected from the group consisting of R and S; $RASQX_1IX_2X_3X_4LX_5$ (SEQ ID NO:1037), wherein $X_1$ is selected from the group consisting of D, G, S and T, $X_2$ is selected from the group consisting of A, R and S, $X_3$ is selected from the group consisting of H, I, N, R, S and T, $X_4$ is selected from the group consisting of D, W and Y, $X_5$ is selected from the group consisting of A, G and N; $QASQDIX_1X_2X_3LN$ (SEQ ID NO:1038), wherein $X_1$ is selected from the group consisting of S and T, $X_2$ is selected from the group consisting of D and N, $X_3$ is selected from the group consisting of S and Y; $RASQX_1VX_2X_3X_4X_5LA$ (SEQ ID NO:1039), wherein $X_1$ is selected from the group consisting of S and T, $X_2$ is selected from the group consisting of I and S, $X_3$ is selected from the group consisting of R and S, $X_4$ is selected from the group consisting of S, N and no amino acid, $X_5$ is selected from the group consisting of Y and no amino acid; and $KSSQX_1X_2LX_3X_4SNNKNYLX_5$ (SEQ ID NO:1040), wherein $X_1$ is selected from the group consisting of N and S, $X_2$ is selected from the group consisting of I and V, $X_3$ is selected from the group consisting of D and Y, $X_4$ is selected from the group consisting of N, R and S, $X_5$ is selected from the group consisting of A and V; or (iv) a CDRL2 selected from the group consisting of SEQ ID NO:218-233; (v) a CDRH2 that differs in amino acid sequence from the CDRL2 of (iv) by an amino acid addition, deletion or substitution of not more than two amino acids; or (vi) a CDR12 amino acid sequence selected from the group consisting of $X_1X_2SNX_3X_4S$ (SEQ ID NO:1041), wherein $X_1$ is selected from the group consisting of E and K, $X_2$ is selected from the group consisting of I and V, $X_3$ is selected from the group consisting of R and W, $X_4$ is selected from the group consisting of D and F; $X_1X_2SX_3LQS$ (SEQ ID NO:1042), wherein $X_1$ is selected from the group consisting of A and T, $X_2$ is selected from the group consisting of A, E and V, $X_3$ is selected from the group consisting of S and T; $X_1ASX_2LQS$ (SEQ ID NO:1043), wherein $X_1$ is selected from the group consisting of A and V, $X_2$ is selected from the group consisting of S and T; $DASX_1LET$ (SEQ ID NO:1044), wherein $X_1$ is selected from the group consisting of I and N; GASSRAT (SEQ ID NO:223); and $WASX_1RES$ (SEQ ID NO:1045), wherein $X_1$ is selected from the group consisting of A and T; or B) a CDRH selected from the group consisting of: (i) a CDRH1 selected from the group consisting of SEQ ID NO:275-299; (ii) a CDRH1 that differs in amino acid sequence from the CDRH1 of (i) by an amino acid addition, deletion or substitution of not more than two amino acids; (iii) a CDRH1 amino acid sequence selected from the group consisting of $GYTX_1TX_2X_3X_4X_5X_6$ (SEQ ID NO:1052), wherein $X_1$ is selected from the group consisting of F and L, $X_2$ is selected from the group consisting of E, G and S, $X_3$ is selected from the group consisting of H, L and Y, $X_4$ is selected from the group consisting of G, S and Y, $X_5$ is selected from the group consisting of I and M, $X_6$ is selected from the group consisting of H and S; $GYX_1FTSYWIG$ (SEQ ID NO:1053), wherein $X_1$ is selected from the group consisting of R and S; $GFTFX_1SX_2X_3MH$ (SEQ ID NO:1054), wherein $X_1$ is selected from the group consisting of R and S, $X_2$ is selected from the group consisting of H and Y, $X_3$ is selected from the group consisting of D and G; $GFX_1FSX_2YX_3MX_4$ (SEQ ID NO:1055), wherein $X_1$ is selected from the group consisting of P and T, $X_2$ is selected from the group consisting of A, R and S, $X_3$ is selected from the group consisting of A and S, $X_4$ is selected from the group consisting of N and S; $GX_1SX_2SX_3X_4X_5X_6X_7WX_8$ (SEQ ID NO:1056), wherein $X_1$ is selected from the group consisting of D and G, $X_2$ is selected from the group consisting of F, I and V, $X_3$ is selected from the group consisting of R, S and no amino acid, $X_4$ is selected from the group consisting of G, Y and no amino acid, $X_5$ is selected from the group consisting of D, G, S and no amino acid, $X_6$ is selected from the group consisting of A, S and Y, $X_7$ is selected from the group consisting of A and Y, $X_8$ is selected from the group consisting of N and S; GFSLSNARMGVS (SEQ ID NO:279); and $GFSLX_1TGGVGVG$ (SEQ ID NO:1057), wherein $X_1$ is selected from the group consisting of S and N; (iv) a CDRH2 selected from the group consisting of SEQ ID NO:300-331; (v) a CDRH2 that differs in amino acid sequence from the CDRH2 of (iv) by an amino acid addition, deletion or substitution of not more than two amino acids; or (vi) a CDRH2 amino acid sequence selected from the group consisting of $X_1X_2X_3X_4X_5X_6GX_7TX_8X_9X_{10}QKX_{11}X_{12}$ (SEQ ID NO:1058), wherein $X_1$ is selected from the group consisting of S and W, $X_2$ is selected from the group consisting of F and I, $X_3$ is selected from the group consisting of D, N and S, $X_4$ is selected from the group consisting of A and P, $X_5$ is selected from the group consisting of E, N and S, $X_6$ is selected from the group consisting of D, N and S, $X_7$ is selected from the group consisting of E, G and N, $X_8$ is selected from the group consisting of I and N, $X_9$ is selected from the group consisting of C, H and Y, $X_{10}$ is selected from the group consisting of A and T, $X_{11}$ is selected from the group consisting of F and L, $X_{12}$ is selected from the group consisting of D and G; $HYPX_1DSDX_2RYSPSFQG$ (SEQ ID NO:1059), wherein $X_1$ is selected from the group consisting of D and G, $X_2$ is selected from the group consisting of A, I and T; $X_1IX_2X_3DGSX_4X_5X_6YX_7DSVX_8G$ (SEQ ID NO:1060), wherein $X_1$ is selected from the group consisting of F and V, $X_2$ is selected from the group consisting of S and W, $X_3$ is selected from the group consisting of D, S and Y, $X_4$ is selected from the group consisting of I, N and T, $X_5$ is selected from the group consisting of K and Q, $X_6$ is selected from the group consisting of N, R and Y, $X_7$ is selected from the group consisting of A, T and V, $X_8$ is selected from the group consisting of K and R; $X_1ISX_2SX_3X_4X_5X_6YYADSVKG$ (SEQ ID NO:1061), wherein $X_1$ is selected from the group consisting of A, H and Y, $X_2$ is selected from the group consisting of G, R and S, $X_3$ is selected from the group consisting of G and S, $X_4$ is selected from the group consisting of G, R and S, $X_5$ is selected from the group consisting of S, T and Y, $X_6$ is selected from the group consisting of I and T; $X_1X_2X_3X_4X_5X_6X_7X_8X_9X_{10}X_{11}YX_{12}X_{13}SX_{14}KS$ (SEQ ID NO:1062), wherein $X_1$ is selected from the group consisting of E, R and Y, $X_2$ is selected from the group consisting of I and T, $X_3$ is selected from the group consisting of H, N and Y, $X_4$ is selected from the group consisting of C, H, S, T and Y, $X_5$ is selected from the group consisting of S and R, $X_6$ is selected from the group consisting of G and S, $X_7$ is selected from the group consisting of G, K, S and T, $X_8$ is selected from the group consisting of T and W, $X_9$ is selected from the group consisting of N and Y, $X_{10}$ is selected from the group consisting of N and no amino acid, $X_{11}$ is selected from the group consisting of D and no amino acid, $X_{12}$ is selected from the group consisting of A and N, $X_{13}$ is selected from the group consisting of P and V, $X_{14}$ is selected from the group consisting of L and V; $X_1$IFSNDEKSYSTSLKS (SEQ ID NO:1063), wherein $X_1$ is selected from the group consisting of H and LI; and LIYWN$X_1X_2$KRYSPSL$X_3$S (SEQ ID NO:1064), wherein $X_1$ is selected from the group consisting of D and V, $X_2$ is selected from the group consisting of D and E, $X_3$ is selected from the group consisting of K and R.

In some embodiments, at least two of, or all three of CDRL1, CDRL2, and CDRL3 sequences are derived from the same group A, B, C, D, E, or F of consensus sequences, and/or at least two, or all three of, CDRH1, CDRH2, and CDRH3 sequences are derived from the same group A, B, C, D, E, F, or G. In other cases CDRs from different consensus sequence groups are mixed and matched.

In yet another embodiment, the isolated antigen binding protein described hereinabove comprises the first amino acid sequence and the second amino acid sequence, both sequences of which are covalently bonded to each other. In a further embodiment, the first amino acid sequence of the isolated antigen binding protein includes the CDRL3 of SEQ ID NO:234-274, CDRL2 of SEQ ID NO:218-233, and CDRL1 of SEQ ID NO:189-217. On the other hand, the second amino acid sequence of the isolated antigen binding protein comprises the CDRH3 of SEQ ID NO:332-372, CDRH2 of SEQ ID NO:300-331, and CDRH1 of SEQ ID NO:275-299.

In one aspect, the isolated antigen binding proteins provided herein can be a monoclonal antibody, a polyclonal antibody, a recombinant antibody, a human antibody, a humanized antibody, a chimeric antibody, a multispecific antibody, or an antibody fragment thereof.

In another embodiment, the antibody fragment of the isolated antigen binding proteins provided herein can be a Fab fragment, a Fab' fragment, an F(ab')$_2$ fragment, an Fv fragment, a diabody, or a single chain antibody molecule.

In a further embodiment, the isolated antigen binding protein provided herein is a human antibody and can be of the IgG1-, IgG2- IgG3- or IgG4-type.

In yet another aspect, the isolated antigen binding protein provided herein can be coupled to a labeling group, such as radioisotope, radionuclide, a fluorescent group, an enzymatic group, a chemiluminescent group, a biotinyl group, or a predetermined polypeptide group, or an effector group, such as a radioisotope, a radionuclide, a toxin, a therapeutic group, or a chemotherapeutic group. Examples of a therapeutic or chemotherapeutic group are calicheamicin, auristatin-PE, geldanamycin, maytanasine, or derivatives thereof.

In yet other aspects, the invention includes antigen binding proteins competing with any of the above described antigen binding proteins.

As will be appreciated by those in the art, for any antigen binding protein with more than one CDR from the depicted sequences, any combination of CDRs independently selected from the depicted sequences is useful. Thus, antigen binding proteins with one, two, three, four, five or six of independently selected CDRs can be generated. However, as will be appreciated by those in the art, specific embodiments generally utilize combinations of CDRs that are non-repetitive, e.g., antigen binding proteins are generally not made with two CDRH2 regions, etc.

Some of the antigen binding proteins provided are discussed in more detail below.

1. Antigen Binding Proteins and Binding Epitopes

When an antigen binding protein is said to bind an epitope within specified residues of a polypeptide, such as HB-EGF, for example, what is meant is that the antigen binding protein specifically binds to a polypeptide consisting of the specified residues (e.g., a specified segment of HB-EGF). Such an antigen binding protein typically does not contact every residue within HB-EGF. Nor does every single amino acid substitution or deletion within HB-EGF, or the extracellular domain of HB-EGF, necessarily significantly affect binding affinity. Epitope specificity of an antigen binding protein can be determined in variety of ways. One approach, for example, involves testing a collection of overlapping peptides of about 15 amino acids spanning the sequence of the antigen and differing in increments of a small number of amino acids (e.g., three amino acids). The peptides are immobilized within the wells of a microtiter dish. Immobilization can be effected by biotinylating one terminus of the peptides. Optionally, different samples of the same peptide can be biotinylated at the amino- and the carboxy-terminus and immobilized in separate wells for purposes of comparison. This is useful for identifying end-specific antigen binding proteins. Optionally, additional peptides can be included by terminating at a particular amino acid of interest. This approach is useful for identifying end-specific antigen binding proteins to internal fragments of HB-EGF. An antigen binding protein or immunologically functional fragment is screened for specific binding to each of the various peptides. The epitope is defined as occurring with a segment of amino acids that is common to all peptides to which the antigen binding protein shows specific binding. Details regarding a specific approach for defining an epitope are set forth in Example 23.

As demonstrated in Example 23, the antigen binding proteins provided herein are capable of binding at least one IHGE-containing epitope and/or an EGF-like domain of HB-EGF.

2. Competing Antigen Binding Proteins

In another aspect, antigen binding proteins are provided that compete with one of the exemplified antibodies or functional fragments binding to the epitope described above for specific binding to HB-EGF. Such antigen binding proteins may also bind to the same epitope as one of the herein exemplified antigen binding proteins, or an overlapping epitope. Antigen binding proteins and fragments that compete with or bind to the same epitope as the exemplified antigen binding proteins are expected to show similar functional properties. The exemplified antigen binding proteins and fragments include those described above, including those with the heavy and light chains, variable region domains and CDRs included in FIGS. 1, 2, 3, 4, 6, and 7.

3. Human Antibodies and Humanization of Antibodies

In one embodiment, the HB-EGF antigen binding proteins are human or humanized antibodies. Human antibodies avoid many of the problems associated with antibodies that possess murine or rat variable and/or constant regions. The presence of such murine or rat derived proteins can lead to the rapid clearance of the antibodies or can lead to the generation of an immune response against the antibody by a patient. In order to avoid the utilization of murine or rat derived antibodies, fully human antibodies have been generated through the introduction of functional human antibody genetic loci into a rodent, other mammal or animal so that the rodent, other mammal or animal produces fully human antibodies.

One method for generating fully human antibodies is through the use of XenoMouse® strains of mice that have been engineered to contain up to but less than 1000 kb-sized germline configured fragments of the human heavy chain locus and kappa light chain locus. See, Mendez et al., 1997, *Nature Genetics* 15:146-156, and Green and Jakobovits, 1998, *J. Exp. Med.* 188:483-495. The XenoMouse® strains are available from Abgenix, Inc. (Fremont, Calif.).

The production of the XenoMouse® strains of mice is discussed and delineated in U.S. patent application Ser. No. 07/466,008, filed Jan. 12, 1990, Ser. No. 07/610,515, filed Nov. 8, 1990, Ser. No. 07/919,297, filed Jul. 24, 1992, Ser. No. 07/922,649, filed Jul. 30, 1992, Ser. No. 08/031,801, filed Mar. 15, 1993, Ser. No. 08/112,848, filed Aug. 27, 1993, Ser. No. 08/234,145, filed Apr. 28, 1994, Ser. No. 08/376,279, filed Jan. 20, 1995, Ser. No. 08/430, 938, filed Apr. 27, 1995, Ser. No. 08/464,584, filed Jun. 5, 1995, Ser. No. 08/464,582, filed Jun. 5, 1995, Ser. No. 08/463,191, filed Jun. 5, 1995, Ser. No. 08/462,837, filed Jun. 5, 1995, Ser. No. 08/486,853, filed Jun. 5, 1995, Ser. No. 08/486,857, filed Jun. 5, 1995, Ser. No. 08/486,859, filed Jun. 5, 1995, Ser. No. 08/462,513, filed Jun. 5, 1995, Ser. No. 08/724,752, filed Oct. 2, 1996, Ser. No. 08/759,620, filed Dec. 3, 1996, U.S. Publication 2003/0093820, filed Nov. 30, 2001 and U.S. Pat. Nos. 6,162,963, 6,150,584, 6,114,598, 6,075,181, and 5,939,598 and Japanese Patent Nos. 3 068 180 B2, 3 068 506 B2, and 3 068 507 B2. See, also European Patent No., EP 0 463 151 B1, grant published Jun. 12, 1996, International Patent Application No., WO 94/02602, published Feb. 3, 1994, International Patent Application No., WO 96/34096, published Oct. 31, 1996, WO 98/24893, published Jun. 11, 1998, WO 00/76310, published Dec. 21, 2000. The disclosures of each of the above-cited patents, applications, and references are hereby incorporated by reference in their entirety.

In an alternative approach, others, including GenPharm International, Inc., have utilized a "minilocus" approach. In the minilocus approach, an exogenous Ig locus is mimicked through the inclusion of pieces (individual genes) from the Ig locus. Thus, one or more $V_H$ genes, one or more $D_H$ genes, one or more $J_H$ genes, a mu constant region, and usually a second constant region (preferably a gamma constant region) are formed into a construct for insertion into an animal. This approach is described in U.S. Pat. No. 5,545,807 to Surani et al. and U.S. Pat. Nos. 5,545,806, 5,625,825, 5,625,126, 5,633,425, 5,661,016, 5,770,429, 5,789,650, 5,814,318, 5,877,397, 5,874,299, and 6,255,458 each to Lonberg and Kay, U.S. Pat. Nos. 5,591,669 and 6,023.010 to Krimpenfort and Berns, U.S. Pat. Nos. 5,612,205, 5,721,367, and 5,789, 215 to Berns et al., and U.S. Pat. No. 5,643,763 to Choi and Dunn, and GenPharm International U.S. patent application Ser. No. 07/574,748, filed Aug. 29, 1990, Ser. No. 07/575, 962, filed Aug. 31, 1990, Ser. No. 07/810,279, filed Dec. 17, 1991, Ser. No. 07/853,408, filed Mar. 18, 1992, Ser. No. 07/904,068, filed Jun. 23, 1992, Ser. No. 07/990,860, filed Dec. 16, 1992, Ser. No. 08/053,131, filed Apr. 26, 1993, Ser. No. 08/096,762, filed Jul. 22, 1993, Ser. No. 08/155,301, filed Nov. 18, 1993, Ser. No. 08/161,739, filed Dec. 3, 1993, Ser. No. 08/165,699, filed Dec. 10, 1993, Ser. No. 08/209,741, filed Mar. 9, 1994, the disclosures of which are hereby incorporated by reference. See, also European Patent No. 0 546 073 B1, International Patent Application Nos. WO 92/03918, WO 92/22645, WO 92/22647, WO 92/22670, WO 93/12227, WO 94/00569, WO 94/25585, WO 96/14436, WO 97/13852, and WO 98/24884 and U.S. Pat. No. 5,981,175, the disclosures of which are hereby incorporated by reference in their entirety.

Kirin has also demonstrated the generation of human antibodies from mice in which, through microcell fusion, large pieces of chromosomes, or entire chromosomes, have been introduced. See, European Patent Application Nos. 773 288 and 843 961, the disclosures of which are hereby incorporated by reference. Additionally, KM™ mice, which are the result of cross-breeding of Kirin's Tc mice with Medarex's minilocus (Humab) mice have been generated. These mice possess the human IgH transchromosome of the Kirin mice and the kappa chain transgene of the Genpharm mice (Ishida et al., 2002, *Cloning Stem Cells* 4:91-102).

Human antibodies can also be derived by in vitro methods. Suitable examples include but are not limited to phage display (CAT, Morphosys, Dyax, Biosite/Medarex, Xoma, Symphogen, Alexion (formerly Proliferon), Affimed) ribosome display (CAT), yeast display, and the like.

E. Preparation of Antibodies

Antibodies, as described herein, were prepared through the utilization of the XenoMouse® technology, as described herein. Such mice are capable of producing human immunoglobulin molecules and antibodies and are substantially deficient in the production of murine immunoglobulin molecules and antibodies. Technologies utilized for achieving production of human antibodies are disclosed in the patents, applications, and references disclosed herein. In some embodiments, transgenic production of mice and human antibodies is performed as disclosed in U.S. patent application Ser. No. 08/759,620, filed Dec. 3, 1996 and International Patent Application Nos. WO 98/24893, published Jun. 11, 1998 and WO 00/76310, published Dec. 21, 2000, the disclosures of which are hereby incorporated by reference. See, also Mendez et al., 1997, *Nature Genetics* 15:146-156, the disclosure of which is hereby incorporated by reference.

Through the use of such technology, fully human monoclonal antibodies to a variety of antigens have been produced. Essentially, XenoMouse® lines of mice are immunized with an antigen of interest (e.g., HB-EGF), lymphatic cells (such as B-cells) are recovered from the hyper-immunized mice, and the recovered lymphocytes are fused with a myeloid-type cell line to prepare immortal hybridoma cell lines. These hybridoma cell lines are screened and selected to identify hybridoma cell lines that produced antibodies specific to the antigen of interest. The supernatants might also be screened for immunoreactivity against fragments of HB-EGF to further map the different antibodies for binding to domains of functional interest on HB-EGF. The antibodies may also be screened for binding to other ligand of EGFR or its family members, other related human chemokines and against the rat, the mouse, and non-human primate, such as cynomolgus monkey, orthologues of HB-EGF, the last to determine species cross-reactivity. Provided herein are methods for the production of multiple hybridoma cell lines that produce antibodies specific to HB-EGF. Further, provided herein are characterization of the antibodies produced by such cell lines, including nucleotide and amino acid sequence analyses of the heavy and light chains of such antibodies.

Alternatively, instead of being fused to myeloma cells to generate hybridomas, B cells can be directly assayed. For example, B cells can be isolated from hyperimmune XenoMouse® mice and allowed to proliferate and differentiate into antibody-secreting plasma cells. Antibodies from the cell supernatants are then screened by ELISA for reactivity against the HB-EGF immunogen. The supernatants might also be screened for immunoreactivity against fragments of HB-EGF to further map the different antibodies for binding to domains of functional interest on HB-EGF. The antibodies may also be screened for binding to other ligands of EGF receptor, or its family members, other related human chemokines and against the rat, the mouse, and non-human primate, such as cynomolgus monkey, orthologues of HB-EGF, the last to determine species cross-reactivity. B cells from wells containing antibodies of interest may be immortalized by various methods including fusion to make hybridomas either from individual or from pooled wells, or by infection with EBV or transfection by known immortalizing genes and then plating in suitable medium. Alternatively, single plasma cells secreting antibodies with the desired specificities are then isolated using an HB-EGF-specific hemolytic plaque assay (Babcook et al., 1996, *Proc. Natl. Acad. Sci. USA* 93:7843-48). Cells targeted for lysis are preferably sheep red blood cells (SRBCs) coated with the HB-EGF antigen.

As discussed, supra, there are a number of isotypes of antibodies including without limitation the following: human IgG1, IgG2, IgG3 and IgG4. It will be appreciated that antibodies that are generated need not initially possess such an isotype but, rather the antibody as generated can possess any isotype and that the antibody can be isotype-switched by using the molecularly cloned V region genes or cloned constant region genes or cDNAs in appropriate expression vectors using conventional molecular biological techniques that are well known in the art and then expressing the antibodies in host cells using techniques known in the art In general, antibodies produced by the fused hybridomas were either human IgG2 heavy chains or human IgG4 heavy chains with fully human kappa chains. Antibodies can also be of other human isotypes, including IgG1 or IgG3. The antibodies possessed high affinities, typically possessing a $K_D$ of from about $10^{-6}$ through about $10^{-12}$ M or below, when measured by solid phase and solution phase techniques. Antibodies possessing a $K_D$ of at least $10^{-9}$ M are preferred to inhibit the activity of HB-EGF. Antibodies possessing a $K_D$ of at least $10^{-10}$ M are also preferred to inhibit the activity of HB-EGF. Antibodies possessing a $K_D$ of at least $10^{-11}$ M are also preferred to inhibit the activity of HB-EGF.

As will be appreciated, anti-HB-EGF antibodies can be expressed in cell lines other than hybridoma cell lines. Sequences encoding particular antibodies can be used to transfect a suitable mammalian host cell. During construction of appropriate vectors for transfection and subsequent expression of antibody, the antibody may be class-switched from one isotype to another, e.g., IgG4 antibodies may be class-switched to IgG2, by techniques known in the art. Transfection can be by any known method for introducing polynucleotides into a host cell, including, for example packaging the polynucleotide in a virus (or into a viral vector) and transducing a host cell with the virus (or vector) or by transfection procedures known in the art, as exemplified by U.S. Pat. Nos. 4,399,216, 4,912,040, 4,740,461, and 4,959,455 (which patents are hereby incorporated herein by reference). The transformation procedure used depends upon the host to be transformed. Methods for introducing heterologous polynucleotides into mammalian cells are well known in the art and include dextran-mediated transfection, calcium phosphate precipitation, polybrene mediated transfection, protoplast fusion, electroporation, encapsulation of the polynucleotide(s) in liposomes, and direct microinjection of the DNA into nuclei.

Mammalian cell lines available as hosts for expression are well known in the art and include many immortalized cell lines available from the American Type Culture Collection (ATCC), including but not limited to Chinese hamster ovary (CHO) cells, HeLa cells, baby hamster kidney (BHK) cells, monkey kidney cells (COS), human hepatocellular carcinoma cells (e.g., Hep G2), human epithelial kidney 293 cells, and a number of other cell lines. Cell lines of particular preference are selected through determining which cell lines have high expression levels and produce high amounts of anti-HB-EGF antibodies.

Alternatively, these antibodies may be prepared from animals genetically engineered to make fully human antibodies or from an antibody display library made in bacteriophage, yeast, ribosome or *E. coli*. See, e.g., Clackson et al., 1991, *Nature* 352:624-628, Marks et al., 1991, *J. Mol. Biol.* 222: 581-597, Feldhaus and Siegel, 2004, *J. Immunol. Methods.* 290:69-80, Groves and Osbourn, 2005, *Expert Opin Biol Ther.* 5:125-135 and Jostock and Dubel, 2005, *Comb Chem High Throughput Screen.* 8:127-133.

Another aspect relates to an isolated nucleic acid molecule encoding an HB-EGF antigen binding protein such as an antibody. Within the context herein, the term "isolated nucleic acid molecule", as used herein, means a polynucleotide of genomic, cDNA, or synthetic origin or some combination thereof, which by virtue of its origin, the "isolated nucleic acid molecule" (1) is not associated with all or a portion of a polynucleotide in which the "isolated polynucleotide" is found in nature, (2) is operably linked to a polynucleotide which it is not linked to in nature, or (3) does not occur in nature as part of a larger sequence. Further, the term "nucleic acid molecule", as referred to herein, means a polymeric form of nucleotides of at least 10 bases in length, either ribonucleotides or deoxynucleotides or a modified form of either type of nucleotide, such as nucleotides with modified or substituted sugar groups and the like. The term also includes single and double stranded forms of DNA. Exemplary nucleic acids encoding antigen binding proteins or portions thereof are described in more detail, infra.

In a one embodiment, a nucleic acid molecule is operably linked to a control sequence. The term "control sequence", as used herein, refers to polynucleotide sequences that are necessary to effect the expression and processing of coding sequences to which they are ligated. The nature of such control sequences differs depending upon the host organism. In prokaryotes, such control sequences generally include promoters, ribosomal binding sites, and transcription termination sequences. In eukaryotes, generally, such control sequences include promoters and transcription termination sequences. The term "control sequence" is intended to include, at a minimum, all components whose presence is essential for expression and processing, and can also include additional components whose presence is advantageous, for example, leader sequences and fusion partner sequences. Furthermore, the term "operably linked", as used herein, refers to positions of components so described which are in a relationship permitting them to function in their intended manner. Moreover, as provided herein, an expression control sequence operably linked to a coding sequence is ligated in such a way that expression of the coding sequence is achieved under conditions compatible with the expression control sequence.

A further aspect is a vector comprising a nucleic acid molecule that encodes an HB-EGF antigen binding protein provided herein. The nucleic acid molecule can be operably linked to a control sequence. Furthermore, the vector may additionally contain a replication origin or a selection marker gene. Examples of vectors that may be used are e.g., plasmids, cosmids, phages, viruses, etc.

F. Antigen Binding Proteins Based on Basic Antibody Structure

As discussed, supra, the basic antibody structural unit is known to comprise a tetramer. Each tetramer is composed of two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of each chain defines a constant region responsible for dimerization effector function, circulating half-life and other functions. Human light chains are classified as kappa and lambda light chains. Heavy chains are classified as mu, delta, gamma, alpha, or epsilon, and define the antibody's isotype as IgM, IgD, IgG, IgA, and IgE, respectively. Within light and heavy chains, the variable and constant regions are joined by a "J" region of about 12 or more amino acids, with the heavy chain also including a "D" region of about 10 more amino acids. See, generally, Fundamental Immunology Ch. 7 (Paul, W., ed., 2nd ed. Raven Press, N.Y. (1989)) (incorporated by reference in its entirety for all purposes). The variable regions of each light/heavy chain pair form the antigen binding site of the antibody.

Thus, an intact IgG antibody has two binding sites. Except in bifunctional or bispecific antibodies, the two binding sites are the same.

The variable regions of the chains all exhibit the same general structure of relatively conserved framework regions (FR) joined by three hyper variable regions, also called complementarity determining regions or CDRs. The CDRs from the two variable regions of each pair are aligned by the framework regions, enabling binding to a specific epitope on the antigen. From N-terminal to C-terminal, the variable regions of both light and heavy chains comprise the domains FR1, CDR1, FR2, CDR2, FR3, CDR3 and FR4. The assignment of amino acids to each domain is in accordance with the definitions of Kabat Sequences of Proteins of Immunological Interest (National Institutes of Health, Bethesda, Md. (1987 and 1991)), or Chothia & Lesk, 1897, *J. Mol. Biol.* 196:901-917; Chothia et al., 1989, *Nature* 342:878-883.

Thus, the antibodies provided herein may include at least one variable region polypeptide chain of the formula: FR1-CDR1-FR2-CDR2-FR3-CDR3-FR4, wherein FR1 is a first human framework region, CDR1 is a first complementarity determining region, FR2 is a second human framework region, CDR2 is a second complementarity determining region, FR3 is a third human framework region, CDR3 is a third complementarity determining region, and FR4 is a fourth human framework region. The CDR3 is generally the most diverse region of the antibody variable region.

In some embodiments, the FR1 region includes but is not limited to any one of amino acid sequences SEQ ID NOs: 373-393 and/or 453-469; the CDR1 region includes but is not limited to any one of amino acid sequences SEQ ID NOs: 189-217 and/or 275-299; the FR2 region includes but is not limited to any one of amino acid sequences SEQ ID NOs: 394-414 and/or 470-481; the CDR2 region includes but is not limited to any one of amino acid sequences SEQ ID NOs: 218-233 and/or 300-331; the FR3 region includes but is not limited to any one of amino acid sequences SEQ ID NOs: 415-440 and/or 482-511; the CDR3 region includes but is not limited to any one of amino acid sequences SEQ ID NOs: 234-274 and/or 332-372; and the FR4 region includes but is not limited to any one of amino acid sequences SEQ ID NOs:441-452 and/or 512-517. Thus, in some embodiments, the human antibodies provided herein have one or more of the amino acid sequences provided herein.

It is to be understood, that the amino acid sequence of the antibodies provided herein is not limited to the twenty conventional amino acids (See, *Immunology—A Synthesis* ($2^{nd}$ Edition, E. S. Golub and D. R. Gren, Eds., Sinauer Associates, Sunderland, Mass. (1991)), which is incorporated herein by reference). For example, the amino acids may include stereoisomers (e.g., D-amino acids) of the twenty conventional amino acids, unnatural amino acids such as $\alpha$-,$\alpha$-disubstituted amino acids, N-alkyl amino acids, lactic acid, and other unconventional amino acids. Examples of unconventional amino acids, which may also be suitable components for the antibody provided, include: 4-hydroxyproline, $\gamma$-carboxyglutamate, $\epsilon$-N,N,N-trimethyllysine, $\epsilon$-N-acetyllysine, O-phosphoserine, N-acetylserine, N-formylmethionine, 3-methylhistidine, 5-hydroxylysine, $\sigma$-N-methylarginine, and other similar amino acids and imino acids, e.g., 4-hydroxyproline.

Furthermore, minor variations in the amino acid sequences shown in SEQ ID NOs:1-517 and 1035-1071 are contemplated as being encompassed, providing that the variations in the amino acid sequence maintain at least 75%, more preferably at least 80%, 90%, 95%, and most preferably 99% of the sequences shown in SEQ ID NOs:1-517 and 1035-1071. Preferred variations in the amino acid sequences shown in SEQ ID Nos:1-517 and 1035-1071, i.e., deletions, insertions and/or replacements of at least one amino acid, occur near boundaries of functional domains. Structural and functional domains can be identified by comparison of the nucleotide and/or amino acid sequence data to public or proprietary sequence databases. Computerized comparison methods can be used to identify sequence motifs or predicted protein conformation domains that occur in other antibodies of known structure and/or function. Methods to identify protein sequences that fold into a known three-dimensional structure are known. See, e.g., Bowie et al., 1991, *Science* 253:164; *Proteins, Structures and Molecular Principles* (Creighton, Ed., W.H. Freeman and Company, New York (1984)); *Introduction to Protein Structure* (C. Branden and J. Tooze, eds., Garland Publishing, New York, N.Y. (1991)); and Thornton et al., 1991, *Nature* 354:105, which are all incorporated herein by reference. Thus, those of skill in the art can recognize sequence motifs and structural conformations that may be used to define structural and functional domains.

Especially preferred variations in the amino acid sequences shown in SEQ ID NOs:1-517 and 1035-1071 are those that lead to a reduced susceptibility to proteolysis or oxidation, alter glycosylation patterns or alter binding affinities or confer or modify other physicochemical or functional properties of the antibody. In particular, conservative amino acid replacements are contemplated. Conservative replacements are those that take place within a family of amino acids that are related in their side chains. Preferred amino acid families are the following: acidic family=aspartate, glutamate; basic family=lysine, arginine, histidine; non-polar family=alanine, valine, leucine, isoleucine, proline, phenylalanine, methionine, tryptophan; and uncharged polar family=glycine, asparagine, glutamine, cysteine, serine, threonine, tyrosine. More preferred families are: aliphatic-hydroxy family=serine and threonine; amide-containing family=asparagine and glutamine; aliphatic family=alanine, valine, leucine and isoleucine; and aromatic family=phenylalanine, tryptophan, and tyrosine. For example, it is reasonable to expect that an isolated replacement of a leucine with an isoleucine or valine, an aspartate with a glutamate, a threonine with a serine, or a similar replacement of an amino acid with a structurally related amino acid will not have a major effect on the binding or properties of the resulting antibody, especially if the replacement does not involve an amino acid within a framework site. However, all other possible amino acid replacements are also encompassed. Whether an amino acid change results in a functional antibody, i.e., in a antibody that binds to HB-EGF and reduces, neutralizes or substantially inhibits the function of HB-EGF, can readily be determined by assaying the specific activity of the resulting antibody in ELISA or FACS for binding to HB-EGF or in vitro or in vivo functional assay.

A reduction, neutralization or substantially inhibition of HB-EGF mediated signal transduction may be caused by influencing, e.g., decreasing or inhibiting, the binding of HB-EGF to its receptor, e.g., to the EGFR or HER4.

The term "antibody" or "anti-HB-EGF antibody", as used herein, means a monoclonal antibody, a polyclonal antibody, a recombinant antibody, a humanized antibody (Jones et al., 1986, *Nature* 321:522-525; Riechmann et al., 1988, *Nature* 332:323-329; and Presta, 1992, *Curr. Op. Struct. Biol.* 2: 593-596), a chimeric antibody (Morrison et al., 1984, *Proc. Natl. Acad. Sci. U.S.A.* 81: 6851-6855), a multispecific antibody (e.g., a bispecific antibody) formed from at least two antibodies, or an antibody fragment thereof. The term "antibody fragment" comprises any portion of the afore-mentioned antibodies, preferably at least one of their antigen binding or variable regions. Examples of antibody fragments include Fab fragments, Fab' fragments, F(ab')$_2$ fragments, Fv fragments, diabodies (Hollinger et al., 1993, *Proc. Natl. Acad. Sci. U.S.A.* 90: 6444-6448), single chain antibody molecules (Plückthun in: The Pharmacology of Monoclonal Antibodies 113, Rosenburg and Moore, EDS, Springer Verlag, N.Y. (1994), 269-315) and other fragments as long as they exhibit the desired capability of binding to HB-EGF.

In addition, the term "antibody" or "anti-HB-EGF antibody", as used herein, may include antibody-like molecules that contain engineered sub-domains of antibodies or naturally occurring antibody variants. These antibody-like molecules may be single-domain antibodies such as VH-only or VL-only domains derived either from natural sources such as camelids (Muyldermans et al., 2001, *Reviews in Molecular Biotechnology* 74, 277-302) or through in vitro display of libraries from humans, camelids or other species (Holt et al., 2003, *Trends Biotechnol.* 21:484-90).

A "Fv fragment" is the minimum antibody fragment that contains a complete antigen-recognition and -binding site. This region consists of a dimer of one heavy- and one light-chain variable domain in tight, non-covalent association. It is in this configuration that the three CDR's of each variable domain interact to define an antigen-binding site on the surface of the $V_H$-$V_L$ dimer. Collectively, the six CDR's confer antigen binding specificity to the antibody. However, even a single variable domain (or half of an Fv comprising only three CDR's specific for an antigen) has the ability to recognize and bind the antigen, although usually at a lower affinity than the entire binding site. The "Fab fragment" also contains the constant domain of the light chain and the first constant domain ($C_H1$) of the heavy chain. The "Fab fragment" differs from the "Fab' fragment" by the addition of a few residues at the carboxy terminus of the heavy chain $C_H1$ domain including one or more cysteines from the antibody hinge region. The "F(ab')$_2$ fragment" originally is produced as a pair of "Fab' fragments" which have hinge cysteines between them. Methods of preparing such antibody fragments, such as papain or pepsin digestion, are known to those skilled in the art.

An antibody provided herein may fix complement (CDC) or activate antibody-dependent cellular cytotoxicity (ADCC), especially an IgG1 antibody, IgG1 variant class-switched from IgG2 or IgG4 or another isotype of human or mammalian origin, by molecular biology or generated de novo from human IgG1 producing mice. Other methods may also be used. An antibody provided herein may sometimes be coupled to a labelling group or an effector group, e.g., a toxin, chemotherapeutic agent, reporter molecule or imaging agent.

G. Further Types of HB-EGF Binding Proteins

In another aspect, the HB-EGF antigen binding protein as provided herein is a scaffold protein having an antibody like binding activity, i.e., binds to HB-EGF.

Within the context of the present invention, the term "scaffold protein", as used herein, means a polypeptidic framework with a high tolerance of its fold for modifications such as multiple insertions, deletions or substitutions. This intrinsic conformational stability enables the directed randomization and drastic changes within a defined region of the protein. Thus, it acquires certain novel properties, whereas its overall structural integrity and original physicochemical behaviour remains conserved. This de novo adopted property mostly, but not exclusively, comprises the binding specificity for a pre-defined target molecule.

Currently, a broad variety of scaffold proteins are in use that imitate the binding principle of a conventional antibody to different degrees (Hey et al., 2005, *Trends in Biotechnol.* 23:514-22). Examples of scaffold proteins that can be used in accordance with the present invention can be subdivided into different groups. Antibody related scaffolds, which are defined as derivatives of antibodies that are either naturally smaller in size and simpler in structure, or have been engineered in this way. This group includes for example so called Nanobodies (reviewed in Hey et al., Trends in Biotechnol. 2005; 23 (10); 514-522), domain antibodies (Holt et al., 2003, *Trends in Biotechnol.* 21:484-489) or shark antigen reactive proteins (Holt et al., Trends in Biotechnol. 2003; 21; 484-489). A second group of scaffold proteins are rigid protein folds which tolerate the insertion or randomization of single loop peptides like the Kunitz-type domain (Dennis et al., 1995; *J. Biol. Cell.* 270:25411-25417), huma transferrin (Ali et al., 1999; *J. Biol. Cell.* 274:24066-24074) or cystein-knot structural motives (Christmann et al., 1999, *Protein Eng.* 12:797-806). Proteins that share the principle of multiple hypervariable loops on a rigid conserved framework in analogy to antibodies are represented by human CTLA-4 (Hufton et al., 2000 *FEBS Lett.* 475:225-231), human fibronectin type III domains (Koide et al., 1998; *J. Mol. Biol.* 284:1141-1151), C-type lectin like domains or lipocalins (Skerra, 2001, *J. Biotechnol.* 74:257-275). Scaffolds with the binding specificity accomplished through aminoacid residues which are positioned partially or completely within the rigid secondary structure of the protein are for example ankyrin repeat proteins (Binz, 2003, *J. Mol. Biol.* 332:489-503), the Z domain of proteinA (Nord et al., 1995, *Protein Eng.* 8:601-608) or γ-crystalline (Fiedler and Rudolph, 2001, International Patent Application WO 01/04144). Scaffold proteins and peptides and applications thereof are reviewed in Hey et al., 2005, *Trends in Biotechnol.* 23:514-522; Binz et al., 2005, *Nature Biotechnol.* 23:1257-1268) and Holliger et al., 2005, *Nature Biotechnol.* 23:11261136.

Engineering of a scaffold protein can be regarded as grafting or integrating an affinity function onto or into the structural framework of a polypeptidic framework with a high tolerance of its fold for modifications. Affinity function means a protein binding affinity according to the present invention. A scaffold can be structurally separable from the amino acid sequences conferring binding specificity. In general, proteins appearing suitable for the development of such artificial affinity reagents may be obtained by rational, or most commonly, combinatorial protein engineering techniques such as panning against an antigen, e.g, HB-EGF, either purified protein or protein displayed on the cell surface, for binding agents in an artificial scaffold library displayed in vitro, using skills which are known in the art (Skerra, 2000, *J. Mol. Recog.* July-August; 13(4):167-87; Binz and Plückthun, 2005, August; 16(4):459-69). In addition, a scaffold protein having an antibody like binding activity can be derived from an acceptor polypeptide, e.g one of the foregoing proteins, containing the scaffold domain, which can be grafted with binding domains of a donor polypeptide to confer the binding specificity of the donor polypeptide onto the scaffold domain containing the acceptor polypeptide. Said inserted binding domains may be, for example, one or more of the complementarity determining region (CDR) of an antibody, in particular an HB-EGF antibody. Preferably the CDR is a CDR3. Insertion can be accomplished by various methods known to those skilled in the art including, for example, polypeptide synthesis, nucleic acid synthesis of an encoding amino acid as well by various forms of recombinant methods well known to those skilled in the art.

H. HB-EGF Antigen Binding Protein Conjugates

In another embodiment, an HB-EGF antigen binding protein, e.g., an antibody provided herein is coupled to a labelling group. Such a labelled antigen binding protein is particularly suitable for diagnostic applications. As used herein, the term "labelling group" refers to a detectable marker, e.g., a radiolabelled amino acid or biotinyl moiety that can be detected by marked avidin (e.g., streptavidin bound to a fluorescent marker or enzymatic activity that can be detected by optical or colorimetric methods). Various methods for labelling polypeptides and glycoproteins, such as antibodies, are known in the art and may be used. Examples of suitable labelling groups include, but are not limited to, the following: radioisotopes or radionuclides (e.g., $^3$H, $^{14}$C, $^{15}$N, $^{35}$S, $^{90}$Y, $^{99}$Tc, $^{111}$In, $^{125}$I, $^{131}$I), fluorescent groups (e.g., FITC, rhodamine, lanthanide phosphors), enzymatic groups (e.g., horseradish peroxidase, β-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In certain respects, it may be desirable that the labelling groups are attached by spacer arms of various lengths to reduce potential steric hindrance.

Alternatively, an HB-EGF antigen binding protein provided herein, such as an antibody, may be coupled to an effector group. Such an effector-modified antigen binding protein is especially suitable for therapeutic applications. As used herein, the term "effector group" refers to a cytotoxic group such as a radioisotope or radionuclide, a toxin, a therapeutic group or other effector group known in the art. Examples for suitable effector groups are radioisotopes or radionuclides (e.g., $^3$H, $^{14}$C, $^{15}$N, $^{35}$S, $^{90}$Y, $^{99}$Tc, $^{111}$In, $^{125}$I, $^{131}$I), calicheamicin, dolastatin analogs such as auristatins, and chemotherapeutic agents such as geldanamycin and maytansine derivates, including DM1. In certain respects, it may be desirable that the effector groups are attached by spacer arms of various lengths to reduce potential steric hindrance.

Also as described herein, many of the highly useful HB-EGF antigen binding protein, e.g., antibody preparations provided herein recognize epitopes within the EGF-like domain of HB-EGF, which includes residues 106-149 of the protein, for example, with the following sequence:
PCLRKYKDFCIHGECKYVKELRAPSCICHPGY HGERCHGLSLP (SEQ ID NO:1076). In some embodiments, the epidermal growth factor epitope recognized by the antigen binding proteins provided herein includes amino acid sequence IHGE. Accordingly, antibody preparations are provided that bind to and recognize an IHGE-containing epitope and/or an EGF-like domain of HB-EGF, for example, SEQ ID NO:1076.

Anti-HB-EGF antigen binding proteins are useful in the detection of HB-EGF in patient samples and accordingly are useful as diagnostics for disease states as described herein. In addition, based on their ability to significantly inhibit HB-EGF and/or EGF receptor activity (as demonstrated in the Examples below), HB-EGF antigen binding proteins have therapeutic effects in treating symptoms and conditions resulting from HB-EGF expression and/or HB-EGF activity. In specific embodiments, the antigen binding proteins and methods herein relate to the treatment of symptoms resulting from HB-EGF-associated diseases, HER4-associated diseases or EGF receptor-associated disease states, for example, cancerous conditions. Further embodiments involve using the antigen binding proteins and methods described herein to treat undesired angiogenesis, neoplastic diseases, such as, melanoma, non-small cell lung cancer, glioma, hepatocellular (liver) carcinoma, thyroid tumor, gastric (stomach) cancer, prostrate cancer, breast cancer, ovarian cancer, bladder cancer, lung cancer, glioblastoma, endometrial cancer, kidney cancer, colon cancer, and pancreatic cancer.

I. Nucleic Acids Encoding HB-EGF Antigen Binding Proteins

Nucleic acids that encode for the antigen binding proteins described herein, or portions thereof, are also provided, including nucleic acids encoding one or both chains of an antibody, or a fragment, derivative, mutein, or variant thereof, polynucleotides encoding heavy chain variable regions or only CDRs, polynucleotides sufficient for use as hybridization probes, PCR primers or sequencing primers for identifying, analyzing, mutating or amplifying a polynucleotide encoding a polypeptide, anti-sense nucleic acids for inhibiting expression of a polynucleotide, and complementary sequences of the foregoing. The nucleic acids can be any length. They can be, for example, 5, 10, 15, 20, 25, 30, 35, 40, 45, 50, 75, 100, 125, 150, 175, 200, 250, 300, 350, 400, 450, 500, 750, 1,000, 1,500, 3,000, 5,000 or more nucleotides in length, and/or can comprise one or more additional sequences, for example, regulatory sequences and/or be part of a larger nucleic acid, for example, a vector. The nucleic acids can be single-stranded or double-stranded and can comprise RNA and/or DNA nucleotides, and artificial variants thereof (e.g., peptide nucleic acids). FIGS. 15A-15V depict the nucleotide sequences for the various light chains of the antigen binding proteins. FIGS. 16A-16AC depict the nucleotide sequences for the various heavy chains of the antigen binding proteins. FIGS. 13A-13M depict the nucleotide sequences of various light chain variable regions of the antigen binding proteins. FIGS. 14A-14L depict the nucleotide sequences of various heavy chain variable regions of the antigen binding proteins. FIGS. 18A-18F depict the nucleotide sequences for various CDR regions of the light chain variable regions of the antigen binding proteins. FIGS. 19A-19G depict the nucleotide sequences for various CDR regions of the heavy chain variable regions of the antigen binding proteins. FIGS. 20A-20K depict the nucleotide sequences for various FR regions of the light chain variable regions of the antigen binding proteins. FIGS. 21A-21K depict the nucleotide sequences for various FR regions of the heavy chain, variable regions of the antigen binding proteins. FIG. 17A depicts the nucleotide sequence of the light chain constant region of the antigen binding proteins. Finally, FIG. 17B depicts the nucleotide sequence of the heavy chain constant region of the antigen binding proteins.

Nucleic acids encoding certain antigen binding proteins, or portions thereof (e.g., full length antibody, heavy or light chain variable domain or CDRH1, CDRH2, CDRH3, CDRL1, CDRL2, or CDRL3) may be isolated from B-cells of mice that have been immunized with HB-EGF or an immunogenic fragment thereof. The nucleic acid may be isolated by conventional procedures such as polymerase chain reaction (PCR). Phage display is another example of a known technique whereby derivatives of antibodies and other antigen binding proteins may be prepared. In one approach, polypeptides that are components of an antigen binding protein of interest are expressed in any suitable recombinant expression system, and the expressed polypeptides are allowed to assemble to form antigen binding protein molecules.

An aspect further provides nucleic acids that hybridize to other nucleic acids (e.g., nucleic acids comprising a nucleotide sequence depicted in FIGS. 13 through 21) under particular hybridization conditions. Methods for hybridizing nucleic acids are well-known in the art. See, e.g., Current Protocols in Molecular Biology, John Wiley & Sons, N.Y. (1989), 6.3.1-6.3.6. As defined herein, a moderately stringent hybridization condition uses a prewashing solution containing 5× sodium chloride/sodium citrate (SSC), 0.5% SDS, 1.0 mM EDTA (pH 8.0), hybridization buffer of about 50% formamide, 6×SSC, and a hybridization temperature of 55° C. (or other similar hybridization solutions, such as one containing about 50% formamide, with a hybridization temperature of 42° C.), and washing conditions of 60° C., in 0.5×SSC, 0.1% SDS. A stringent hybridization condition hybridizes in 6×SSC at 45° C., followed by one or more washes in 0.1× SSC, 0.2% SDS at 68° C. Furthermore, one of skill in the art can manipulate the hybridization and/or washing conditions to increase or decrease the stringency of hybridization such that nucleic acids comprising nucleotide sequences that are at least 65%, 70%, 75%, 80%, 85%, 90%, 95%, 98% or 99% identical to each other typically remain hybridized to each other.

The basic parameters affecting the choice of hybridization conditions and guidance for devising suitable conditions are set forth by, for example, Sambrook, Fritsch, and Maniatis (2001, Molecular Cloning: A Laboratory Manual, Cold Spring Harbor Laboratory Press, Cold Spring Harbor, N.Y., supra and Current Protocols in Molecular Biology, 1995, Ausubel et al., eds., John Wiley & Sons, Inc., sections 2.10 and 6.3-6.4), and can be readily determined by those having ordinary skill in the art based on, e.g., the length and/or base composition of the nucleic acid.

Changes can be introduced by mutation into a nucleic acid, thereby leading to changes in the amino acid sequence of a polypeptide (e.g., an antibody or antibody derivative) that it encodes. Mutations can be introduced using any technique known in the art. In one embodiment, one or more particular amino acid residues are changed using, for example, a site-directed mutagenesis protocol. In another embodiment, one or more randomly selected residues is changed using, for example, a random mutagenesis protocol. However it is made, a mutant polypeptide can be expressed and screened for a desired property.

Mutations can be introduced into a nucleic acid without significantly altering the biological activity of a polypeptide that it encodes. For example, one can make nucleotide substitutions leading to amino acid substitutions at non-essential amino acid residues. Alternatively, one or more mutations can be introduced into a nucleic acid that selectively changes the biological activity of a polypeptide that it encodes. For example, the mutation can quantitatively or qualitatively change the biological activity. Examples of quantitative changes include increasing, reducing or eliminating the activity. Examples of qualitative changes include changing the antigen specificity of an antibody.

Another aspect provides nucleic acid molecules that are suitable for use as primers or hybridization probes for the detection of nucleic acid sequences. A nucleic acid molecule can comprise only a portion of a nucleic acid sequence encoding a full-length polypeptide, for example, a fragment that can be used as a probe or primer or a fragment encoding an active portion (e.g., a HB-EGF binding portion) of a polypeptide.

Probes based on the sequence of a nucleic acid can be used to detect the nucleic acid or similar nucleic acids, for example, transcripts encoding a polypeptide. The probe can comprise a label group, e.g., a radioisotope, a fluorescent compound, an enzyme, or an enzyme co-factor. Such probes can be used to identify a cell that expresses the polypeptide.

Another aspect provides vectors comprising a nucleic acid encoding a polypeptide or a portion thereof (e.g., a fragment containing one or more CDRs or one or more variable region domains). Examples of vectors include, but are not limited to, plasmids, viral vectors, non-episomal mammalian vectors and expression vectors, for example, recombinant expression vectors. The recombinant expression vectors can comprise a nucleic acid in a form suitable for expression of the nucleic acid in a host cell. The recombinant expression vectors include one or more regulatory sequences, selected on the basis of the host cells to be used for expression, which is operably linked to the nucleic acid sequence to be expressed. Regulatory sequences include those that direct constitutive expression of a nucleotide sequence in many types of host cells (e.g., SV40 early gene enhancer, Rous sarcoma virus promoter and cytomegalovirus promoter), those that direct expression of the nucleotide sequence only in certain host cells (e.g., tissue-specific regulatory sequences, see, Voss et al., 1986 *Trends Biochem. Sci.* 11:287, Maniatis et al., 1987, *Science* 236:1237, incorporated by reference herein in their entireties), and those that direct inducible expression of a nucleotide sequence in response to particular treatment or condition (e.g., the metallothionin promoter in mammalian cells and the tet-responsive and/or streptomycin responsive promoter in both prokaryotic and eukaryotic systems (see, id.). It will be appreciated by those skilled in the art that the design of the expression vector can depend on such factors as the choice of the host cell to be transformed, the level of expression of protein desired, etc. The expression vectors can be introduced into host cells to thereby produce proteins or peptides, including fusion proteins or peptides, encoded by nucleic acids as described herein.

Another aspect provides host cells into which a recombinant expression vector has been introduced. A host cell can be any prokaryotic cell (for example, *E. coli*) or eukaryotic cell (for example, yeast, insect, or mammalian cells (e.g., CHO cells)). Vector DNA can be introduced into prokaryotic or eukaryotic cells via conventional transformation or transfection techniques. For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Preferred selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die), among other methods.

Figure 36:
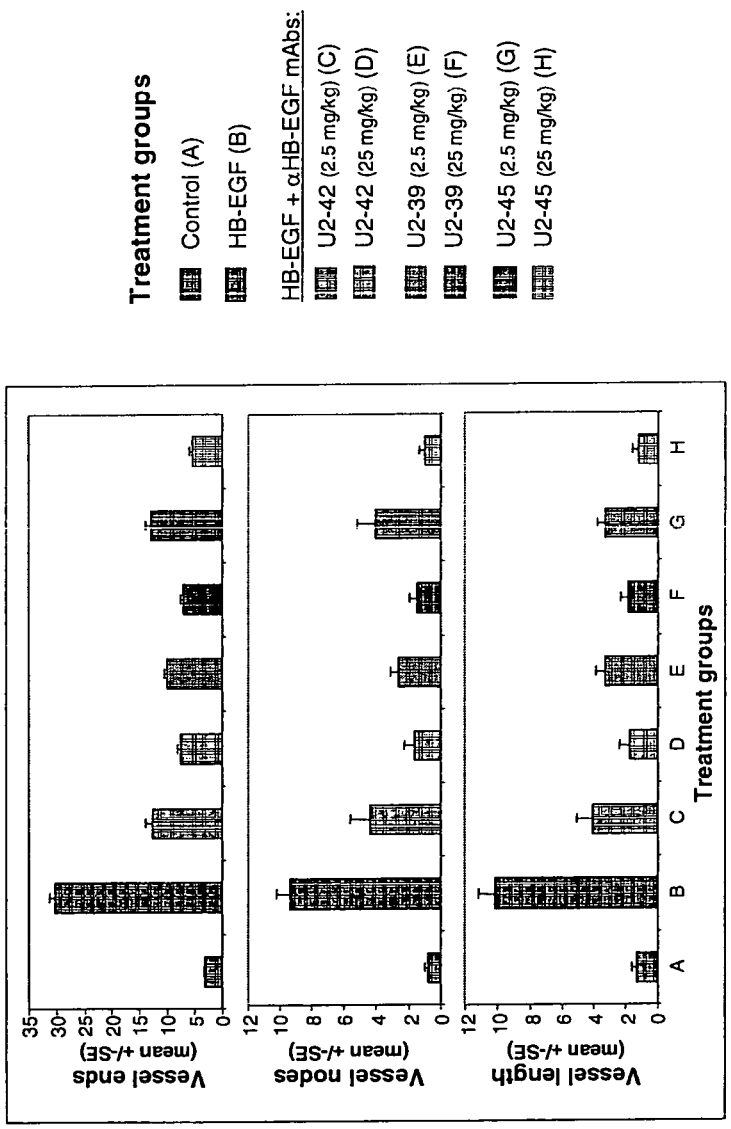
FIG. 36 shows that anti-HB-EGF antibodies inhibit HB-EGF induced angiogenesis in vivo. Angiogenic network formation in a mouse matrigel plug assay could be blocked in a dose-dependent manner by antibodies U2-42, U2-39 and U2-45.
Figure 37:
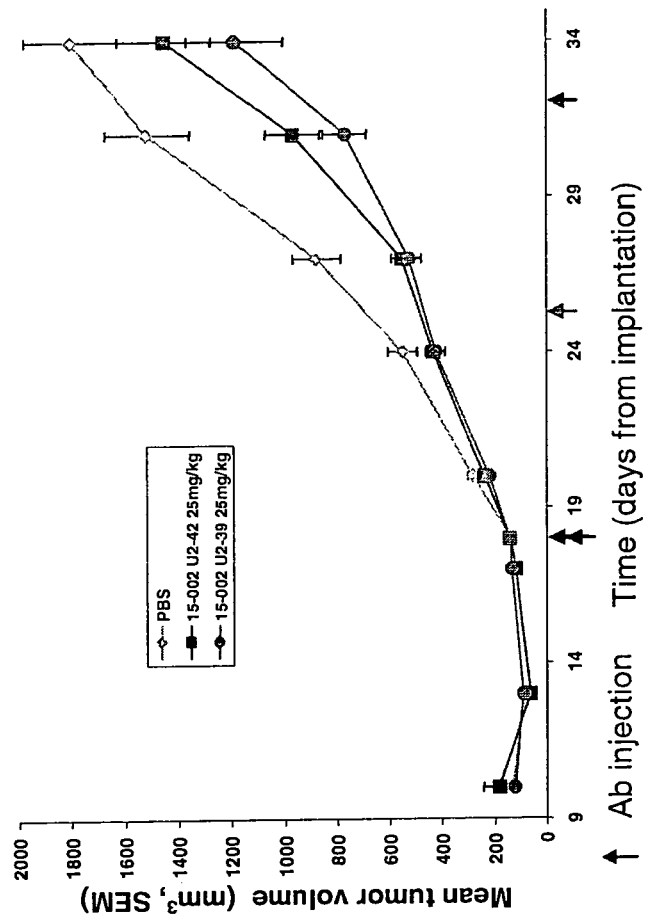
FIG. 37 illustrates inhibition of the growth of established BxPC3 tumors in mouse xenograft models by antibodies U2-42 and U2-39.
Figure 38A:
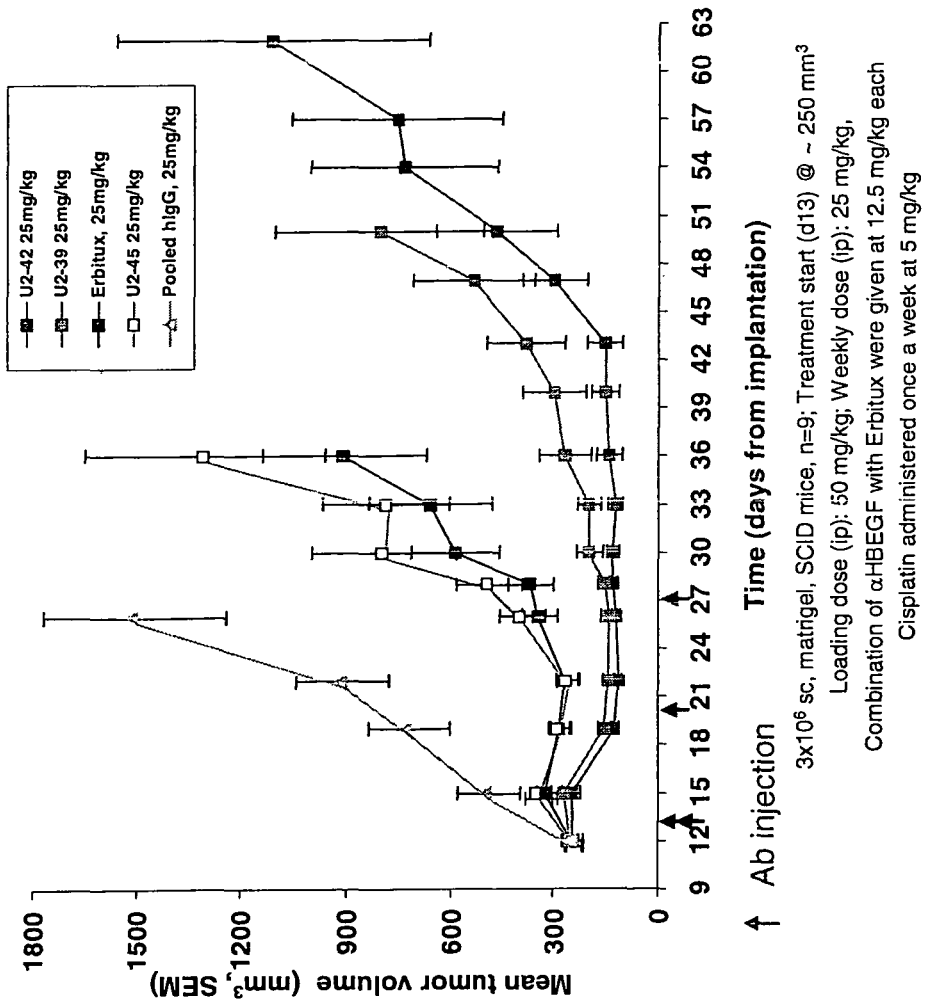
FIGS. 38A-38C illustrate inhibition of the growth of established EFO-27 HB-EGF clone 58 tumors in mouse xenograft models by antibodies U2-42, U2-39 and U2-45 (FIG. 38A).
Figure 38:
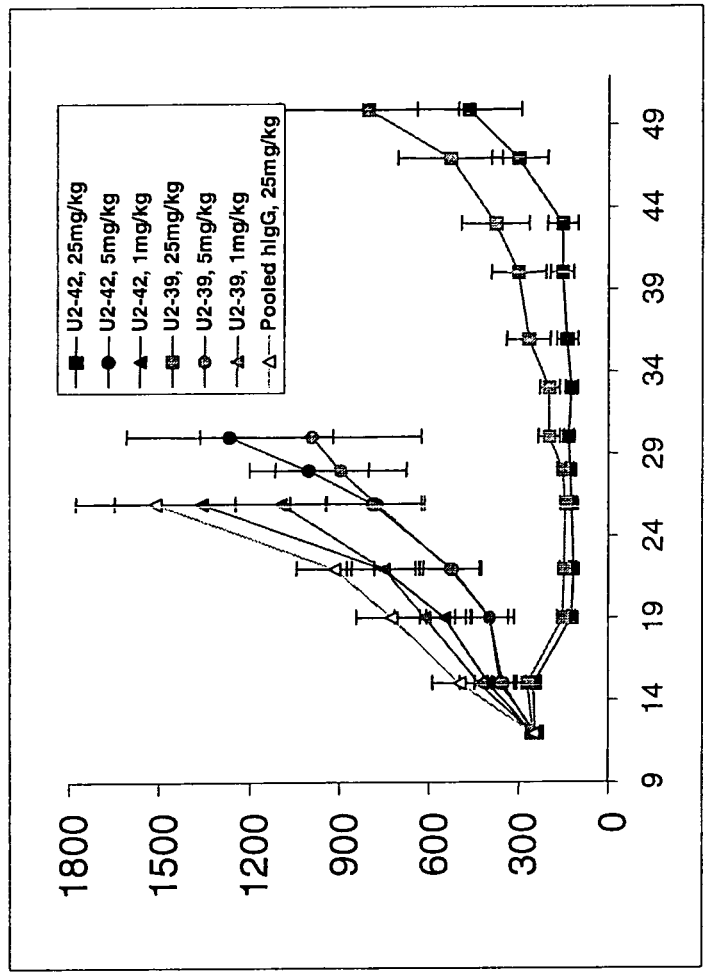

J. Use of HB-EGF Antigen Binding Proteins for Diagnostic and Therapeutic Purposes 1. Indications The HB-EGF antigen binding proteins as described herein can be used to detect or treat a number of diseases and disorders, including those involving excessive cellular proliferation, undesirable cellular migration and/or aberrant angiogenesis. For example, these HB-EGF antigen binding proteins can inhibit HB-EGF-induced EGFR and/or HER4 tyrosine phosphorylation in cancerous cells (FIGS. 22-29). Such inhibition can interrupt the cascade of the signaling events that drives cell proliferation and migration, and angiogenesis. Further, the HB-EGF antigen binding proteins can interfere with the transactivation of the EGFR. In addition, these antigen binding proteins inhibit basal HUVEC cell proliferation (FIG. 32B), endothelial cell tube formation (FIG. 33) and HB-EGF-induced vessel formation in a matrigel plug assay in vivo (FIG. 36). These results indicate that the HB-EGF antigen binding proteins as described herein inhibit angiogenesis in vitro and in vivo. Moreover, these antigen binding proteins also inhibit anchorage independent cell growth (FIG. 34 and FIG. 35) and xenograft tumor growth in mice (FIG. 37 and FIG. 38). Significantly, the HB-EGF antigen binding proteins also inhibit migration of MCF-7 and MDA-MB231 cancer cells (see, FIGS. 27 and 27). Thus, the HB-EGF antigen binding proteins as described herein attack several steps in the development of tumors and other cancerous conditions, including signaling events that control cell proliferation, angiogenesis and cell migration associated with the spread and development of metastatic cancer. Such multifaceted intervention is highly beneficial for controlling and inhibiting the process by which cancer develops. Furthermore, cancers at any stage of progression (e.g., primary, metastatic and recurrent cancers) can be treated.

In addition to the HB-EGF antigen binding proteins' use in detecting and treating cancers in various stages of progression, these antigen binding proteins may also be useful for detecting a number of different types of cancer. For example, HB-EGF is expressed at very low levels in normal breast and pancreatic tissues. However, HB-EGF is expressed at high levels in about 55% pancreatic cancer cells and about 70% of breast cancer cells. Furthermore, as described in the Examples, HB-EGF expression was detected in various cancer cell lines, indicating that the HB-EGF antigen binding proteins described herein can be used for detection of a variety of cancer types.

For example, cancers that can be detected or treated by the claimed antigen binding proteins include solid mammalian tumors as well as hematological malignancies. Solid mammalian tumors include cancers in children such as, for example, germ cell tumors, soft tissue sarcomas, primary brain tumors, neuroblastoma, nephroblastoma and carcinoma, in particular squamous carcinoma and epithelial carcinoma. Solid mammalian tumors may also include adult cancers such as, for example, tumors of unknown origin, primary brain cancer in adults, tumors of the pituitary gland, lip, oral cavity, Nasopharynx, larynx, maxillary sinus, Ethmoid sinus, salivary glands, thyroid gland (including para thyroid glands and carcinoid), esophagus, stomach, pancreas, small intestine, colon, rectum, anal canal, liver, gallbladder, extra hepatic bile ducts, ampulla of vater, carcinoid, endocrine tumors of gastro-entero-hepatic system, pheochromocytoma and paraganglioma, adrenal glands, lung, pleura, mediastinum, thymus, tumors of bone and soft tissue, skin tumors of lip, eyelid, external ear, other unspecified parts of the face, scalp and neck, trunk, upper limb and shoulder, lower limb and hip, vulva, penis, scrotum, breast tumors, gynecological tumors of vulva, vagina, cervix uteri, corpus uteri, ovary, fallopian tube, gestational and trophoblastic tumors, penis, prostate, testis, kidney, renal pelvis and ureter, urinary bladder, urethra, ophthalmic tumors of eyelid, conjunctiva, uvea, retina, orbit and lacrimal gland. Hematological malignancies include childhood, for example, leukemia and lymphomas, acute and chronic leukemia (AML, ANLL, ALL, CML, MDS), Hodgkin's disease, B-Cell, T-Cell, large cell, follicular, indolent/low grade, aggressive/high grade lymphomas of lymphocytic and cutaneous origin, plasma cell neoplasm and cancers associated with AIDS.

In addition, the HB-EGF antigen binding proteins described herein may also be used to detect or treat cancerous conditions or neoplasia disorders, which include, for example, adenoma, tubulovillous adenoma, villous adenoma, angiofibroma, atypical proliferating mucinous neoplasias, Brenner tumor, carcinoid, cavernous hemangioma, cellular leiomyoma, chorangioma, congenital mesoblastic nephroma, mucinous cystadenoma, serous cystadenoma, dermoid, desmoid, fibroadenoma, fibroma, fibrothecoma, follicular adenoma, ganglioneuroma, giant cell tumor, granular cell tumor, granulosa cell tumor, hemangioma, intraductal papilloma, islet cell tumor, leiomyoma, lipoma, luteoma, meningioma, mole, myelolipoma, myxoma, neurofibroma, nevus, osteochondroma, pheochromocytoma, polyposis, schwannoma, serous cystadenoma, struma ovarii, synovial chrondromatosis, benign thymoma.

Further examples of the types of cancers that can be detected or treated with the HB-EGF proteins as described herein may be found, for example, from the American Cancer Society (www.cancer.org), or from Wilson et al. (1991) Harrison's Principles of Internal Medicine, $12^{th}$ Edition, McGraw-Hill, Inc.

Therefore, the HB-EGF antigen binding proteins as described herein can be used to treat and/or prevent cancer, cancerous conditions, tumor growth, metastasis of cancer cells, angiogenic processes and/or neoplastic disorders. Thus, these antigen binding proteins provide a method of treating or preventing cancer in a subject that involves administering to the subject an effective amount of a composition comprising one of the human and/or monoclonal HB-EGF antigen binding protein preparations as described herein, or a combination thereof.

A high proportion of solid tumor diseases are often characterized by tumor angiogenesis, the excessive growth of (abnormal) vessels in the tumor tissue mediated by growth factors (i.e., VEGF) and other factors (i.e., HB-EGF). Targeting HB-EGF through a HB-EGF-specific antigen binding protein could prevent the formation of new vessels and therefore limit the expansion of existing tumors and the development of new tumors (i.e., metastases).

Besides its role as a mitogenic and pro-invasive ligand several studies have substantiated the picture of HB-EGF as an important regulator of angiogenic processes in cancer. As illustrated in the Examples, a function of HB-EGF in the regulation of angiogenesis in vivo was shown. Thus, the antigen binding proteins as described herein can be used for treating diseases associated with or caused by angiogenesis, e.g., cancerous or non-cancerous diseases.

For example HB-EGF antigen binding proteins as described herein may interfere with the communication between smooth muscle cells (SMCs) and endothelial cells, a fundamental process in the development and functionality of blood vessels in angiogenesis, e.g., tumor angiogenesis.

Furthermore, these antigen binding proteins may at least partially inhibit the HB-EGF induced expression and release of VEGF from SMCs which acts subsequently as a powerful endothelial mitogen. Similarly, VEGF increases HB-EGF production in endothelial cells which therefore constitutes a pro-angiogenic feedback loop consisting of these two important ligands that can be disrupted by administering the HB-EGF antigen binding proteins as described herein. Recently, and in addition to VEGF, further critical pro-angiogenic constituents such as angiopoetin 1 and 2 (Ang-1 & 2) and their receptor TIE-2 as well as the potent smooth muscle cell GPCR stimulus angiotensin II (ATII) were identified. Interestingly, HB-EGF is a critical mediator of ATII-induced EGFR transactivation and downstream upregulation of VEGF and Ang-2 in endothelial cells. In vivo, ATII induces angiogenesis in an HB-EGF-dependent manner and enhanced the angiogenic activity of VEGF. These findings support that in parallel to VEGF, HB-EGF is able to activate additional angiogenic pathways via Ang2. Therefore, aberrant angiogenesis or cancer in a mammal may be treated with the administration of an effective amount of the HB-EGF antigen binding protein described herein.

Besides its role as an important regulator of angiogenic processes in cancer, various non-cancer indications with activated angiogenic pathways and the requirement of collateral blood flow are putative disease areas for HB-EGF antigen binding protein therapy.

Chronic inflammatory diseases (e.g., nephritis, COPD, inflammatory bowel disease) including immune system mediated "inflammatory reactions" (e.g., graft versus host disease, transplant rejection, restenosis), metabolic diseases (e.g., diabetes), or chronic hypoxic conditions are often characterized by hyper- and/or neo-vascularization (e.g., chronic ulcers). The described HB-EGF antigen binding proteins may at least partially inhibit the essential process for angiogenesis—the recruitment of vascular smooth muscle cells by endothelial cells induced by HB-EGF either produced by inflammatory cells or upregulated by hypoxia—and represent therefore an attractive route for interventional therapy of excessive/pathological vascularization.

In obese subjects, increased levels of HB-EGF derived from the accumulated fat which contribute to the higher incidence of vascular disease in obesity, can be neutralized by the HB-EGF antigen binding proteins described herein. A therapeutic intervention with an HB-EGF antigen binding protein may act therefore directly as an anti-adipocytokine in interrupting the adipovascular axis.

In fibroblasts, HB-EGF significantly downregulates elastin mRNA via activation of epidermal growth factor receptor. This effect provides an avenue of intervention in the development of lung fibrosis.

Moreover HB-EGF is a mitogen of keratinocytes involved in the pathogenesis of inflammatory diseases. In addition, expression of HB-EGF and co-localization with the EGFR may play an important role in the early pathogenesis of psoriasis which opens a potential therapeutic window in the treatment of cutaneous inflammatory diseases and specifically in the early treatment of psoriasis with the claimed antigen binding proteins.

Targeting HB-EGF with the described antigen binding proteins may also result in a treatment option for patients with proliferative vitreoretinopathy (PVR), since the development of PVR is accompanied by a significant upregulation of HB-EGF in PVR retinas. In addition HB-EGF expression in fibroproliferative tissue and its stimulatory effect on glial cell proliferation, chemotaxis, and VEGF secretion suggest that HB-EGF may be a factor mediating glial cell responses during PVR. These principles can also be applied to further angiogenesis-dependent eye diseases such as age-related and non age-related macular degeneration, diabetic retinopathy, rubeotic glaucoma, interstitial keratitis, retinopathy of prematurity and corneal graft failure.

GPCRs such as adrenoceptors and angiotensin receptors have been linked to the pathogenesis of hypertension due to their vasoconstrictive and growth promoting abilities. Since HB-EGF is a critical mediator of these pathways, neutralizing antigen binding proteins are suitable for targeted intervention in hypertensive disorders such as cardiac hypertrophy and congestive heart failure, kidney failure or stroke.

HB-EGF, a potent mitogen and chemoattractant for smooth muscle cells (SMCs), was detected in atherosclerotic plaques of coronary arteries with intimal thickening and produced by SMCs and macrophages. Remnant lipoproteins which are known causative agents of atherosclerosis were furthermore shown to induce SMC proliferation via HB-EGF mediated EGFR transactivation. Therefore, the HB-EGF antigen binding proteins as described herein represent selective and efficient agents targeting atherosclerosis by blocking critical smooth muscle cell functions. In addition restenosis after percutaneous coronary intervention which is characterized by proliferation of smooth muscle cells might also be prevented by specific neutralization of HB-EGF function.

Thus, the HB-EGF antigen binding proteins as described herein can be used to treat a variety of diseases, including non-malignant proliferative diseases such as aberrant angiogenesis, leiomyoma (uterine fibrosis), benign smooth muscle cell tumors, glomerulosclerosis (hyperproliferation of mesangial cells), smooth muscle cell hyperplasia, atherosclerosis (hyperproliferation of vascular smooth muscle cells), rubeosis; neovascular glaucoma, diabetic retinopathy, diabetic blindness, macular degeneration, rheumatoid arthritis, cardiac hypertrophy, psoriasis, and the like.

In a further aspect, these HB-EGF antigen binding proteins can be used to treat disorders associated with or accompanied by a disturbed, e.g., pathologically enhanced growth factor receptor activation.

In another aspect, this enhanced growth factor receptor activation may be associated with or caused by a pathological increase in the activity of a G protein and/or a G protein coupled receptor. It should be noted that disorders that are associated with or accompanied by a disturbed, e.g., pathologically enhanced growth factor receptor activation and which are may be associated with or caused by a pathological increase in the activity of a G protein and/or a G protein coupled receptor, can be delimited from other disorders characterized by an enhanced activity of growth factor receptor activation in that a transactivation of the growth factor receptor via G protein coupled receptor takes place.

2. Diagnostic Methods

The HB-EGF antigen binding molecules as described herein may be used in a method for detecting cancer cells in a test sample that includes contacting the test sample with the antigen binding molecule and detecting whether the antibody binds to a cell expressing proHB-EGF or HB-EGF molecules in the sample. The degree to which binding occurs can be assessed by use of a control sample. The test and control samples can, for example, be blood, serum, ascites, pleural effusion, cerebro-spinal fluid, tissue, cell, urine, lymph, saliva, milk or other samples. Such a control sample can be a non-cancerous sample of the fluid or tissue or cell type. In some embodiments, the control sample is a non-cancerous sample obtained from the same subject as the test sample. "Subject" or "patient" refers to a mammal, preferably a human, in need of treatment for or detection of a condition, disorder or disease.

Figure 39:
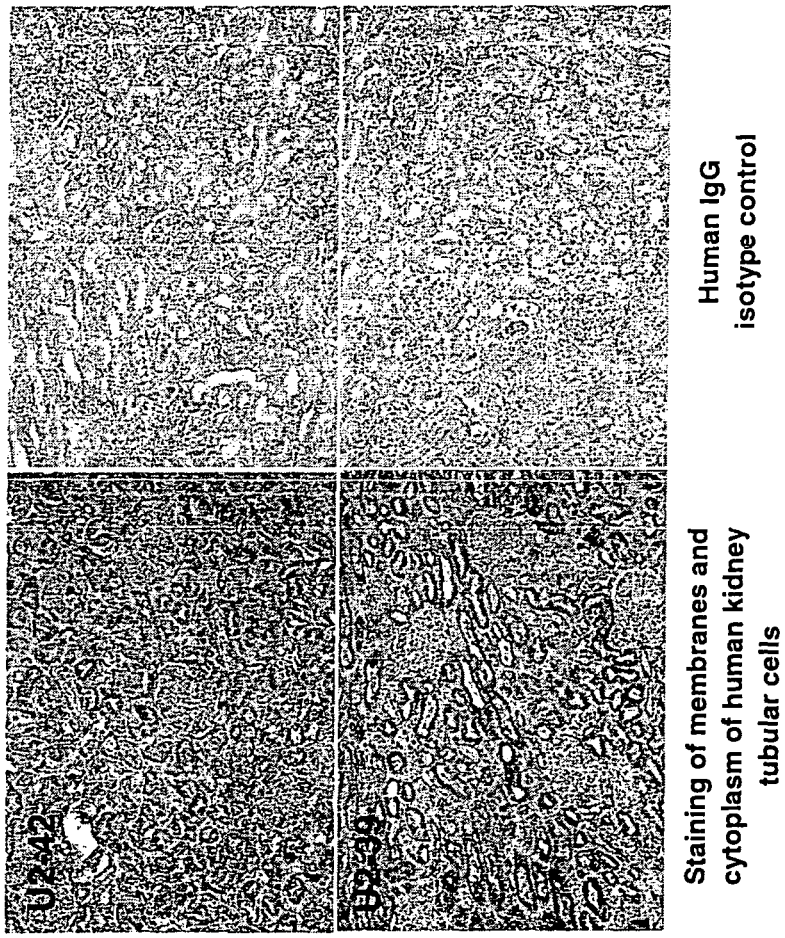
FIGS. 39A-39B illustrate the use of the human anti-HB-EGF antibodies for detection of HB-EGF in human tissue by immunohistochemistry (FIG. 39A) and by ELISA (FIG. 39B).
Figure 39:
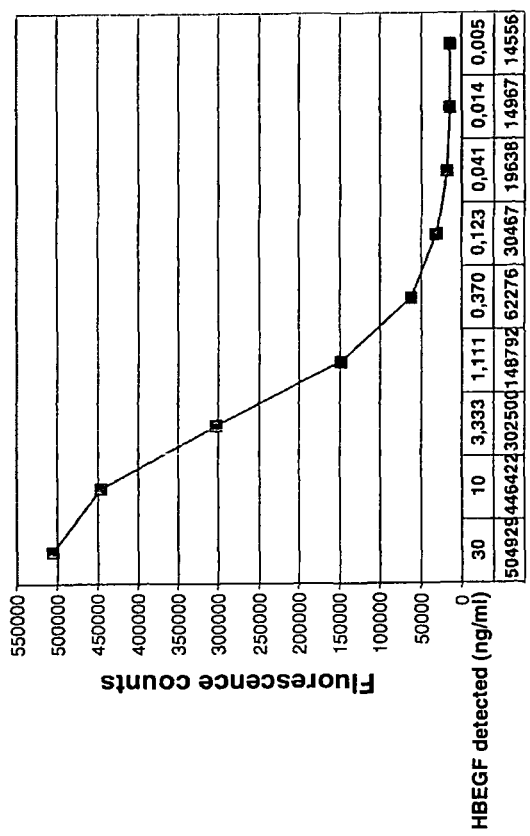

The binding of antibody to components of the test sample can be detected by detecting a reporting molecule, imaging agent or label that is bound or can be selectively bound to a antigen binding protein as described herein. These HB-EGF antigen binding proteins can have one or more reporter molecules, labels or imaging agents. A reporter molecule is defined as any moiety that may be detected using an assay. Non-limiting examples of reporter molecules that have been conjugated to antibodies include enzymes, radiolabels, haptens, fluorescent labels, phosphorescent molecules, chemiluminescent molecules, chromophores, luminescent molecules, photoaffinity molecules, colored particles or ligands, such as biotin. The reporting molecule can provide a detectable signal. For example, the detectable signal can be a fluorescent, phosphorescent, chemiluminescent, electrochemiluminescent, electrochemical, color change or enzymatic signal. Anti-HB-EGF antibodies provided herein can be used as capturing antibodies for ELISA-based detection of the growth factor or immunohistochemical analysis of tissue samples as shown in FIG. 39.

In some embodiments, the reporting molecule is covalently bound to a antigen binding protein as described herein. In other embodiments, the reporting molecule can be selectively bound to the HB-EGF antigen binding protein as described herein. Such selective binding of a reporting molecule to the described antigen binding protein can be accomplished by a secondary antibody with the label covalently bound thereto, where the secondary antibody selectively binds to an HB-EGB antigen binding protein as described herein.

3. Methods of Treatment: Pharmaceutical Formulations, Routes of Administration Treatment of, or treating, cancer is intended to include the alleviation of or diminishment of at least one symptom typically associated with the disease. The treatment also includes alleviation or diminishment of more than one of the associated symptoms. The treatment may cure the cancer, e.g., it may substantially eliminate the cancer cells and/or arrest the growth of the cancerous tumor. Alternatively, treatment may slow the progression of the cancer.

Anti-cancer activity can be evaluated against varieties of cancers or cancer cells using methods available to one of skill in the art. Anti-cancer activity, for example, can be determined by identifying the $LD_{100}$ or $ED_{50}$ of a preparation of the antigen binding proteins described herein that prevents the growth of a cancer. In one embodiment, anti-cancer activity is the amount of antibody that kills 50% or 100% of the cancer cells when measured using standard dose response methods.

The HB-EGF antigen binding proteins as described herein can be administered alone, or in combination with antibodies, chemotherapeutic drugs or radiation therapy. Pharmaceutical compositions according to the invention may be administered as monotherapy or in combination with another pharmaceutical composition, preferably comprising another anti-neoplastic agent, in particular Cisplantin or Avastin. For example, the described HB-EGF antigen binding proteins can be co-administered with anti-tumor antibodies, (e.g., chimeric, humanized or human anti-tumor antibodies), with antibodies that specifically bind to VEGF to further inhibit tumor angiogenesis, or with antibodies that specifically bind to a receptor tyrosine kinase such as HER2, HER4 or EGFR and therefore further inhibit tumor cell proliferation. In FIG. 38, the synergistic effect of an anti-EGFR antibody and antiHB-EGF antibodies could be shown for both therapeutic antiHB-EGF antibodies tested. Further, the HB-EGF antigen binding proteins described herein may be co-administered with other anti-tumor agents. Specific examples of anti-tumor agents which can be co-administered with the antibodies provided herein include, for example, gefitinib, lapatinib, sunitinib, pemetrexed, bevacisumab, cetuximab, imatinib, trastuzumab, alemtuzumab, rituximab, erlotinib, bortezomib and the like. Any other anti-cancer agent or drug that can inhibit cancer or tumor cell proliferation can also be used in the compositions as described and claimed herein. For example, the claimed compositions can include chemotherapeutic agents such as capecitabine, daunorubicin, daunomycin, dactinomycin, doxorubicin, epirubicin, idarubicin, esorubicin, bleomycin, mafosfamide, ifosfamide, cytosine arabinoside, bis-chloroethylnitrosurea, busulfan, mitomycin C, actinomycin D, mithramycin, prednisone, hydroxyprogesterone, testosterone, tamoxifen, dacarbazine, procarbazine, hexamethylmelamine, pentamethylmelamine, mitoxantrone, amsacrine, chlorambucil, methylcyclohexylnitrosurea, nitrogen mustards, melphalan, cyclophosphamide, 6-mercaptopurine, 6-thioguanine, cytarabine (CA), 5-azacytidine, hydroxyurea, deoxycoformycin, 4-hydroxyperoxycyclophosphoramide, 5-fluorouracil (5-FU), 5-fluorodeoxyuridine (5-FUdR), methotrexate (MTX), colchicine, taxol, vincristine, vinblastine, etoposide, trimetrexate, teniposide, cisplatin, avastin and diethylstilbestrol (DES). See, generally, The Merck Manual of Diagnosis and Therapy, 15th Ed. 1987, pp. 1206-1228, Berkow et al., eds., Rahway, N.J. When used with the described HB-EGF antigen binding proteins, such chemotherapeutic agents may be used individually (e.g., 5-FU and an antibody), sequentially (e.g., 5-FU and an antibody for a period of time followed by MTX and an antibody), or in combination with one or more other such chemotherapeutic agents (e.g., 5-FU, MTX and an antibody, or 5-FU, radiotherapy and an antibody).

Also provided is a method of evaluating a therapeutically effective dosage for treating a cancer with an antibody having an amino acid sequence disclosed herein, that includes determining the $LD_{100}$ or $ED_{50}$ of the HB-EGF antigen binding protein preparation in vivo or in vitro. Such a method permits calculation of the approximate amount of antigen binding protein needed per volume to inhibit cancer cell growth or metastasis by about 10% to 100%, or about 20% to 100%, or about 25% to 100%, or about 30% to 100%, or about 40% to 100%, or about 50% to 100%. In some embodiments, less than 100% inhibition of cancer cell growth or metastasis is observed. For example, cancer cell growth and/or metastasis is inhibited by about 90%, 80%, 70%, 60%, or 50%. Percentage inhibition can be determined, for example, by administration of the antigen binding protein preparation to SCID or nu/nu mice available in the art wherein tumor cells have been introduced and/or by standard methods using cultured cancer cells (see, FIG. 38B). Several methods are described in the Examples.

Also included are sterile pharmaceutical formulations of the HB-EGF antigen binding proteins as described herein that are useful as treatments for diseases including, for example, cancer and/or aberrant angiogenesis. Such formulations would inhibit the binding of HB-EGF to its receptor, e.g., EGFR or to HER4, thereby effectively treating pathological conditions where, for example, serum, cellular or tissue HB-EGF is abnormally elevated or where its receptors, e.g., EGFR or HER4, are abnormally active. As illustrated herein the HB-EGF antigen binding proteins possess adequate affinity to potently neutralize HB-EGF and to modulate the signaling events associated with the HB-EGF receptors.

The HB-EGF antigen binding proteins as described herein are preferably humanized antigen binding proteins. Administration of these humanized antigen binding proteins reduce the probability of a negative side effect. Moreover, these antigen binding proteins are stable in vivo, for example, because they are recognized as normal human products, thereby minimizing the risk of immune system responses. Moreover, these antigen binding proteins are not prone to proteolytic destruction, improving their circulating half-lives. Hence, the HB-EGF preparations as described herein have an excellent half-life in vivo so that administration in humans is comparatively infrequent. Such a prolonged duration of action may allow for less frequent and more convenient dosing schedules by alternate parenteral routes such as subcutaneous or intramuscular injection.

Sterile formulations can be created, for example, by filtration through sterile filtration membranes, prior to or following lyophilization and reconstitution of the antibody. The antigen binding proteins as described herein are ordinarily stored in lyophilized form or in solution. Therapeutic antibody compositions generally are placed into a container having a sterile access port, for example, an intravenous solution bag or vial having an adapter that allows retrieval of the formulation, such as a stopper pierceable by a hypodermic injection needle.

The route of administration of the HB-EGF antigen binding proteins are in accord with known methods, e.g., injection or infusion by intravenous, subcutaneous, intradermal, intraperitoneal, intracerebral, intramuscular, intraocular, intraarterial, intrathecal, intravesical, intra-cavernous, inhalation, intralesional routes, or by sustained release systems as noted below. In some embodiments, the antigen binding proteins as described herein are administered continuously by infusion or by bolus injection.

The HB-EGF antigen binding proteins, as described herein, can be prepared in a mixture with a pharmaceutically acceptable carrier. This therapeutic composition can be administered intravenously or through the nose or lung, preferably as a liquid or powder aerosol (lyophilized). The composition may also be administered parenterally or subcutaneously as desired. When administered systemically, the therapeutic composition should be sterile, pyrogen-free and in a parenterally acceptable solution with consideration for what are physiologically acceptable pH values, isotonicity, and stability. These conditions are known to those skilled in the art. Briefly, dosage formulations of the compounds described herein are prepared for storage or administration by mixing the compound having the desired degree of purity with physiologically acceptable carriers, excipients, or stabilizers. Such materials are non-toxic to the recipients at the dosages and concentrations employed, and include buffers such as TRIS HCl, phosphate, citrate, acetate and other organic acid salts; antioxidants such as ascorbic acid; low molecular weight (less than about ten residues) peptides such as polyarginine, proteins, such as serum albumin, gelatin, or immunoglobulins; hydrophilic polymers such as polyvinylpyrrolidinone; amino acids such as glycine, glutamic acid, aspartic acid, or arginine; monosaccharides, disaccharides, and other carbohydrates including cellulose or its derivatives, glucose, mannose, or dextrins; chelating agents such as EDTA; sugar alcohols such as mannitol or sorbitol; counterions such as sodium and/or nonionic surfactants such as TWEEN, PLURONICS or polyethyleneglycol.

Sterile compositions for injection can be formulated according to conventional pharmaceutical practice as described in *Remington: The Science and Practice of Pharmacy* ($20^{th}$ ed, Lippincott Williams & Wilkens Publishers (2003)). For example, dissolution or suspension of the active compound in a vehicle such as water or naturally occurring vegetable oil like sesame, peanut, or cottonseed oil or a synthetic fatty vehicle like ethyl oleate or the like may be desired. Buffers, preservatives, antioxidants and the like can be incorporated according to accepted pharmaceutical practice.

Suitable examples of sustained-release preparations include semipermeable matrices of solid hydrophobic polymers containing the polypeptide, which matrices are in the form of shaped articles, films or microcapsules. Examples of sustained-release matrices include polyesters, hydrogels (e.g., poly(2-hydroxyethyl-methacrylate) as described by Langer et al., 1981, *J. Biomed Mater. Res.* 15:167-277 and Langer, 1982, *Chem. Tech.* 12:98-105, or poly(vinylalcohol)), polylactides (U.S. Pat. No. 3,773,919, EP 58,481), copolymers of L-glutamic acid and gamma ethyl-L-glutamate (Sidman et al., 1983, *Biopolymers* 22:547-556), non-degradable ethylene-vinyl acetate (Langer et al., supra), degradable lactic acid-glycolic acid copolymers such as the LUPRON Depot™ (injectable microspheres composed of lactic acid-glycolic acid copolymer and leuprolide acetate), and poly-D-(−)-3-hydroxybutyric acid (EP 133,988).

While polymers such as ethylene-vinyl acetate and lactic acid-glycolic acid enable release of molecules for over 100 days, certain hydrogels release proteins for shorter time periods. When encapsulated proteins remain in the body for a long time, they may denature or aggregate as a result of exposure to moisture at 37° C., resulting in a loss of biological activity and possible changes in immunogenicity. Rational strategies can be devised for protein stabilization depending on the mechanism involved. For example, if the aggregation mechanism is discovered to be intermolecular S—S bond formation through disulfide interchange, stabilization may be achieved by modifying sulfhydryl residues, lyophilizing from acidic solutions, controlling moisture content, using appropriate additives, and developing specific polymer matrix compositions.

Sustained-released compositions also include preparations of crystals of the antigen binding protein suspended in suitable formulations capable of maintaining crystals in suspension. These preparations when injected subcutaneously or intraperitoneally can produce a sustained release effect. Other compositions also include liposomally entrapped antibodies. Liposomes containing such antibodies are prepared by methods known per se: U.S. Pat. No. DE 3,218,121; Epstein et al., 1985, *Proc. Natl. Acad. Sci. USA* 82:3688-3692; Hwang et al., 1980, *Proc. Natl. Acad. Sci. USA* 77:4030-4034; EP 52,322; EP 36,676; EP 88,046; EP 143,949; 142,641; Japanese patent application 83-118008; U.S. Pat. Nos. 4,485,045 and 4,544,545; and EP 102,324.

The dosage of the antigen binding protein formulation for a given patient will be determined by the attending physician taking into consideration various factors known to modify the action of drugs including severity and type of disease, body weight, sex, diet, time and route of administration, other medications and other relevant clinical factors. Therapeutically effective dosages may be determined by either in vitro or in vivo methods.

An effective amount of the antigen binding proteins, described herein, to be employed therapeutically will depend, for example, upon the therapeutic objectives, the route of administration, and the condition of the patient. Accordingly, it is preferred for the therapist to titer the dosage and modify the route of administration as required to obtain the optimal therapeutic effect. A typical daily dosage might range from about 0.001 mg/kg to up to 100 mg/kg or more, depending on the factors mentioned above. Typically, the clinician will administer the therapeutic antigen binding protein until a dosage is reached that achieves the desired effect. The progress of this therapy is easily monitored by conventional assays or as described herein.

It will be appreciated that administration of therapeutic entities in accordance with the compositions and methods herein will be administered with suitable carriers, excipients, and other agents that are incorporated into formulations to provide improved transfer, delivery, tolerance, and the like. These formulations include, for example, powders, pastes, ointments, jellies, waxes, oils, lipids, lipid (cationic or anionic) containing vesicles (such as Lipofectin™) DNA conjugates, anhydrous absorption pastes, oil-in-water and water-in-oil emulsions, emulsions carbowax (polyethylene glycols of various molecular weights), semi-solid gels, and semi-solid mixtures containing carbowax. Any of the foregoing mixtures may be appropriate in treatments and therapies involving the HB-EGF antigen binding protein as described herein, provided that the active ingredient in the formulation is not inactivated by the formulation and the formulation is physiologically compatible and tolerable with the route of administration. See, also Baldrick P. "Pharmaceutical excipient development: the need for preclinical guidance," 2000, *Regul. Toxicol. Pharmacol.* 32:210-218; Wang, "Lyophilization and development of solid protein pharmaceuticals," 2000, *Int. J. Pharm.* 203:1-60; Charman W N "Lipids, lipophilic drugs, and oral drug delivery-some emerging concepts," *J. Pharm. Sci.* 89:967-978; Powell et al., 1998, "Compendium of excipients for parenteral formulations," *PDA J. Pharm. Sci. Technol.* 52:238-311 and the citations therein for additional information related to formulations, excipients and carriers well known to pharmaceutical chemists.

The following examples, including the experiments conducted and results achieved are provided for illustrative purposes only and are not to be construed as limiting upon the teachings herein.

EXAMPLES

K. Example 1

Generation of Immunogen

HB-EGF including EGF-like domain (aa 1-149) was amplified from a pcDNA3-VSV-HB-EGF expression construct (Prenzel et al., 1999, supra) and cloned into an expression vector that provides an in-frame 6His tag at the carboxyl-terminus (pcDNA 3.1 myc-his, InVitrogen). This HB-EGF immunogen with C-terminal myc(HIS)$_6$ tag was expressed in HEK293 cells and purified by a two step purification on Ni-NTA sepharose (Amersham Pharmacia) and heparin sepharose (Sigma).

The HB-EGF portion of the immunogen had the following sequence (SEQ ID NO:1077).

```
  1 MKLLPSVVLK LFLAAVLSAL VTGESLERLR RGLAAGTSNP

41 DPPTVSTDQL LPLGGGRDRK VRDLQEADLD LLRVTLSSKP

81 QALATPNKEE HGKRKKKGKG LGKKRDPCLR KYKDFCIHGE

121 CKYVKELRAP SCICHPGYHG ERCHGLSLP
```

B. Example 2

Immunization of Xenomouse Mice and Titers Observed

Monoclonal antibodies against HB-EGF were developed by sequentially immunizing XenoMouse® mice (XenoMouse strains: XMG2 (human IgG2-producing) and XM3C-1 (human IgG4-producing), Abgenix, Inc. Fremont, Calif.).

1. Immunization

XenoMouse animals were immunized via the footpad for all injections. The total volume of each injection was 50 µl per mouse, 25 µl per footpad.

For both cohort 1 (10 XMG2 mice) and Cohort 2 (10 XM3C-1), the initial immunization was with 10 µg of HB-EGF protein admixed 1:1 (v/v) with TITERMAX GOLD® (Sigma, Oakville, ON) per mouse. The subsequent four boosts were made with 10 µg of HB-EGF protein admixed 1:1 (v/v) with 100 µg alum gel (Sigma, Oakville, ON) in pyrogen-free D-PBS. The fifth boost consisted of 10 µg of HB-EGF protein admixed 1:1 (v/v) with TITERMAX GOLD®. The sixth and seventh injection consisted of 10 µg of HB-EGF protein admixed 1:1 v/v with 100 µg alum gel. A final boost was made with 10 µg of HB-EGF protein in pyrogen-free DPBS, without adjuvant. The XenoMouse mice were immunized on days 0, 4, 8, 14, 18, 21, 25, and 28 for this protocol and fusions were performed on day 32. The two bleeds were made through Retro-Orbital Bleed procedure on day 16 after the fourth boost, on day 23 after the sixth boost.

2. Selection of Animals for Harvest by Titer

Anti-HB-EGF antibody titers in the serum from immunized XenoMouse mice were determined by ELISA. Briefly, the HB-EGF protein (2 µg/ml) was coated onto Costar Labcoat Universal Binding Polystyrene 96-well plates (Corning, Acton, Mass.) overnight at 4° C. in Antigen Coating Buffer (0.1 M Carbonate Buffer, pH 9.6 NaHCO$_3$ (MW 84) 8.4 g/L). The next day, the plates were washed one time with washing buffer (0.05% Tween 20 in 1×PBS) using a Biotek plate washer. The plates were then blocked with 200 µl/well blocking buffer (0.5% BSA, 0.1% Tween 20, 0.01% Thimerosal in 1×PBS) and incubated at room temperature for 1 hour. After the one-hour blocking, the plates were washed one time with washing buffer using a Biotek plate washer. Sera from either the HB-EGF protein immunized XenoMouse mice or naïve XenoMouse animals were titrated in 0.5% BSA/PBS buffer at 1:3 dilutions in duplicate from a 1:100 initial dilution. The last well was left blank. These plates were incubated at room temperature for 2 hours, and the plates were then washed three times with washing buffer using a Biotek plate washer. A goat anti-human IgG Fc-specific horseradish peroxidase (CALTAG, Cat NO, H10507) conjugated antibody was added at a final concentration of 1:2000 in blocking buffer and incubated for 1 hour at room temperature. The plates were washed three times with washing buffer using a Biotek plate washer. After washing, the plates were developed with the addition of TMB chromogenic substrate (BioFx BSTP-0100-01) for 10-20 minutes or until negative control wells start to show color. Then the ELISA was stopped by the addition of Stop Solution (650 nM Stop reagent for TMB (BioFx BSTP-0100-01), reconstituted with 100 ml H₂O per bottle). The specific titer of each XenoMouse animal was determined from the optical density at 650 nm and is shown in TABLE 1 below. The titer value is the reciprocal of the greatest dilution of sera with an OD reading two-fold that of background. Therefore, the higher the number, the greater was the humoral immune response to HB-EGF.

TABLE 1

| Mouse ID | After 4 inj. Reactivity to HB-EGF | After 6 inj. |
|---|---|---|
| Group 1, fp, XMG2, 10 mice, | | |
| P4721 | 3,800 | 59,000 |
| P4722 | 6,500 | 68,000 |
| P4723 | 2,500 | 43,000 |
| P4724 | 2,400 | 22,000 |
| P4725 | 2,400 | 71,000 |
| P4726 | 450 | 58,000 |
| P4727 | 1,600 | 20,000 |
| P4728 | 2,700 | 61,000 |
| P4729 | 800 | 61,000 |
| P47210 | 5,700 | 78,000 |
| NC | <100 | <100 |
| PC | <100 | <100 |
| Group 2, fp, XM3C-1, 10 mice, | | |
| P2664 | 35 | 2,300 |
| P2666 | 20 | 750 |
| P2669 | 30 | 850 |
| P26610 | 75 | 1,900 |
| P2892 | 60 | 550 |
| P2894 | 60 | 1,400 |
| P2895 | 95 | 2,600 |
| P2896 | 45 | 2,500 |
| P3672 | 50 | 2,000 |
| P3678 | 60 | 1,800 |
| NC | <100 | <100 |
| PC | 35 | 20 |

C. Example 3

Hybridoma Generation and Primary Screen for Binders

Immunized mice were sacrificed and the lymph nodes were harvested and pooled from each cohort. The lymphoid cells were dissociated by grinding in DMEM to release the cells from the tissues, and the cells were suspended in DMEM. The cells were counted, and 0.9 ml DMEM per 100 million lymphocytes was added to the cell pellet to resuspend the cells gently but completely. Using 100 μl of CD90+ magnetic beads per 100 million cells, the cells were labeled by incubating the cells with the magnetic beads at 4° C. for 15 minutes. The magnetically-labeled cell suspension containing up to $10^8$ positive cells (or up to $2 \times 10^9$ total cells) was loaded onto a LS+ column and the column washed with DMEM. The total effluent was collected as the CD90-negative fraction (most of these cells were expected to be B cells).

The fusion was performed by mixing washed enriched B cells from above and nonsecretory myeloma P3X63Ag8.653 cells purchased from ATCC, cat. # CRL 1580 (Kearney et al., 1979, *J. Immunol.* 123:1548-1550) at a ratio of 1:1. The cell mixture was gently centrifuged at 800 g. After complete removal of the supernatant, the cellular pellet was treated with 2-4 ml of Pronase solution (CalBiochem, cat. #53702; 0.5 mg/ml in PBS) for no more than 2 minutes. Then, 3-5 ml of FBS was added to stop the enzyme activity and the suspension was adjusted to 40 ml total volume using electro cell fusion solution, ECFS (0.3 M Sucrose, Sigma, Cat# S7903, 0.1 mM Magnesium Acetate, Sigma, Cat# M2545, 0.1 mM Calcium Acetate, Sigma, Cat# C4705). The supernatant was removed after centrifugation and the cells were resuspended in 40 ml ECFS. This wash step was repeated and the cells again were resuspended in ECFS to a concentration of $2 \times 10^6$ cells/ml.

Electro-cell fusion was performed using a fusion generator, model ECM2001, Genetronic, Inc., San Diego, Calif. The fusion chamber size used was 2.0 ml, using the following instrument settings: Alignment condition: voltage: 50 V, time: 50 seconds; membrane breaking at: voltage: 3000 V, time: 30 μsec; post-fusion holding time: 3 seconds.

After electro-cell fusion, the cell suspensions were carefully removed from the fusion chamber under sterile conditions and transferred into a sterile tube containing the same volume of Hybridoma Culture Medium (DMEM (JRH Biosciences), 15% FBS (Hyclone), supplemented with L-glutamine, pen/strep, OPI (oxaloacetate, pyruvate, bovine insulin) (all from Sigma) and IL-6 (Boehringer Mannheim)). The cells were incubated for 15-30 minutes at 37° C., and then centrifuged at 400 g for five minutes. The cells were gently resuspended in a small volume of Hybridoma Selection Medium (Hybridoma Culture Medium supplemented with 0.5×HA (Sigma, cat. #A9666)), and the volume was adjusted appropriately with more Hybridoma Selection Medium, based on a final plating of $5 \times 10^6$ B cells total per 96-well plate and 200 μL per well. The cells were mixed gently and pipetted into 96-well plates and allowed to grow. On day 7 or 10, one-half the medium was removed, and the cells were re-fed with Hybridoma Selection Medium.

After 14 days of culture, hybridoma supernatants from the cohort #1 and cohort #2 were screened for HB-EGF-specific monoclonal antibodies by ELISA. In the Primary screen, the ELISA plates (Fisher, Cat. No. 12-565-136) were coated with 50 μL/well of HB-EGF protein (2 μg/ml) in Coating Buffer (0.1 M Carbonate Buffer, pH 9.6, NaHCO₃ 8.4 g/L), then incubated at 4° C. overnight. After incubation, the plates were washed with Washing Buffer (0.05% Tween 20 in PBS) one time. 200 μL/well Blocking Buffer (0.5% BSA, 0.1% Tween 20, 0.01% Thimerosal in 1×PBS) were added and the plates were incubated at room temperature for 1 hour. After incubation, the plates were washed with Washing Buffer one time. Aliquots (50 μL/well) of hybridoma supernatants and positive and negative controls were added, and the plates were incubated at room temperature for 2 h. The positive control used throughout was serum from the relevant HB-EGF protein-immunized XenoMouse mouse and the negative control was serum from a KLH-immunized relevant strain of XenoMouse mouse. After incubation, the plates were washed three times with Washing Buffer. 100 μL/well of detection antibody goat anti-huIgGFc-HRP (Caltag Inc., Cat. No. H10507, using concentration was 1:2000 dilution) was added and the plates were incubated at room temperature for 1 hour. After incubation, the plates were washed three times with Washing Buffer and 100 μl/well of TMB (BioFX Lab. Cat. No. TMSK-0100-01) was added. Plates were then allowed to develop for about 10 minutes (until negative control wells barely started to show color). 50 μl/well stop solution (TMB Stop Solution (BioFX Lab. Cat. No. STPR-0100-01) was then added and the plates were read on an ELISA plate reader at a wavelength of 450 nm.

The old culture supernatants from the positive hybridoma cells growth wells based on primary screen were removed and the HB-EGF positive hybridoma cells were suspended with fresh hybridoma culture medium and were transferred to 24-well plates. After 2 days in culture, these supernatants were ready for a secondary confirmation screen. In the secondary confirmation screen, the positives in the first screening were screened by ELISA (described as above) with two sets of detective antibodies: goat anti-huIgGFc-HRP (Caltag Inc., Cat. No. H10507, using concentration was 1:2000 dilution) for human gamma chain detection and goat anti-hIg kappa-HRP (Southern Biotechnology, Cat. No. 2060-05) for human kappa light chain detection in order to demonstrate that the antibody preparation was HB-EGF-specific and fully human in its composition. The two sets of ELISA procedures were identical to the descriptions above except the two different detection antibodies were used separately.

In parallel with the secondary confirmation screen, the counter ELISA screen was performed to exclude those antibodies that respond to myc(his)$_6$ tag. The ELISA procedures were identical to the descriptions above except the coated with irrelevant myc(his)$_6$ tag protein (ML-myc(his)$_6$ protein) instead of coating with HB-EGF myc(his)$_6$ protein.

After the secondary confirmation and the counter ELISA screen, 49 fully human IgG/kappa HB-EGF specific monoclonal antibodies were identified from cohorts 1 and 2.

D. Example 4

Scale-Up and Testing of Antibodies in Functional Assays

This Example describes the identification of hybridoma cell lines that produce anti-HB-EGF antibodies with affinity for HB-EGF.

1. FACS Detection of Hybridoma-Produced Anti-HB-EGF Antibodies Bound to HB-EGF Expressing Cell-Lines HB-EGF expression on cell-lines was determined by FACS analysis. To perform this analysis 2×10$^5$ selected HB-EGF-expressing cells were harvested with 10 mM EDTA in PBS, resuspended in FACS-buffer (PBS, 3% FCS, 0.4% azide) and seeded on a 96-well round bottom plate. After centrifugation for 3 minutes at 1000 rpm to remove supernatant, the cells were resuspended in hybridoma-derived anti-HB-EGF antibody dilution (100 µl/well) and incubated at 4° C. for 45 min. The cells were washed twice with FACS buffer and resuspended with secondary antibody (100 µl/well) donkey-anti-human-PE (Jackson) diluted 1:100 in FACS buffer. The cell suspensions were incubated at 4° C. in the dark for 30 min, washed twice with FACS buffer and analyzed (FACS, Beckman Coulter).

The results of these assays are provided in TABLES 2 and 3 below, which provide the fluorescence mean values for each FACS assay. As illustrated in TABLES 3 and 4, substantially no HB-EGF expression was detected in CHO control cells that do not express HB-EGF. However, when HB-EGF is recombinantly overexpressed in CHO cells, several monoclonal antibody preparations exhibit significant binding to those HB-EGF-expressing cells. Binding to MDA-MB231, SCC-9 and COS-7 cells was somewhat variable but an antibody preparation that bound to one HB-EGF-expressing cell type typically bound to another. As shown in TABLE 2, several antibody preparations, including, for example, the U2-24, U2-5, U2-19, U2-21, U2-15 and U2-42 antibody preparations exhibited strong binding to HB-EGF-expressing CHO cells. Similarly, antibody preparations U2-39, U2-26, U2-44, U2-45 and U2-48 also exhibited good binding to HB-EGF-expressing CHO cells.

TABLE 2

FACS Analysis Of Anti-HB-EGF Antibody Supernatants (Cohort 1)

| Antibody | CHO control cells vs. HB-EGF-expressing CHO cells | | Cell Lines Endogenously Expressing HB-EGF | | |
|---|---|---|---|---|---|
| | CHO-K1 | CHO-HB-EGF | MDA-MB231 | SCC-9 | COS-7 |
| KLH | 0.2 | 0.3 | 0.4 | 0.2 | 0.4 |
| U2-18 | 0.3 | 154 | 3.1 | 1.2 | 1.6 |
| U2-68 | 0.2 | 238 | 1.7 | 0.6 | 1.1 |
| U2-24 | 0.2 | 360 | 2 | 0.6 | 6.7 |
| U2-14 | 0.3 | 132 | 2.8 | 0.8 | 1.1 |
| U2-1 | 0.2 | 64 | 1.8 | 0.7 | 3.1 |
| U2-32 | 0.2 | 76 | 1.7 | 1.2 | 1.8 |
| U2-40 | 0.2 | 137 | 2.1 | 1.3 | 1.1 |
| U2-5 | 0.3 | 371 | 6.9 | 1.7 | 2.2 |
| U2-8 | 0.3 | 148 | 3.7 | 1.4 | 1.4 |
| U2-13 | 0.2 | 136 | 0.4(2.6) | 0.5 | 0.8 |
| U2-17 | 0.2 | 170 | 1.6 | 0.6 | 1.4 |
| U2-19 | 0.4 | 347 | 5.5 | 1.8 | 6.1 |
| U2-38 | 0.3 | 30 | 3.9 | 0.9 | 1.4 |
| U2-21 | 0.2 | 344 | 3.9 | 3.4 | 2.1 |
| U2-15 | 0.2 | 370 | 3 | 0.6 | 0.9 |
| U2-16 | 0.2 | 197 | 1.5 | 0.4 | 0.9 |
| U2-30 | 0.3 | 273 | 3.5 | 1 | 3.4 |
| U2-44 | 0.3 | 5.6 | 0.8 | 0.2 | 5.2 |
| U2-42 | 1.2 | 277 | 3.3 | 0.5 | 6.7 |
| U2-36 | 0.9 | 112 | 1.6 | 0.3 | 4.9 |
| U2-22 | 0.3 | 221 | 1.1 | 0.2 | 4.9 |
| U2-56 | 0.2 | 38 | 0.5 | 0.2 | 1.8 |
| Neg | 0.2 | 0.2 | 0.3 | | |
| Pos (goat aHB) | 0.2 | 80 | 3 | | |

TABLE 3

FACS Analysis Of Anti-HB-EGF Antibody Supernatants (Cohort 2)

| Antibody | CHO control cells vs. HB-EGF-expressing CHO cells | | Cell Lines Endogenously Expressing HB-EGF | | |
|---|---|---|---|---|---|
| | CHO-K1 | CHO-HB-EGF | MDA-MB231 | SCC-9 | COS-7 |
| U2-63 | 0.2 | 36(0.4) | 0.5 | 0.2 | 0.6 |
| U2-54 | 0.3 | 49 | 0.6 | 0.2 | 2.4 |
| U2-65 | 0.2 | 1.9 | 0.4 | 0.2 | 0.3 |
| U2-10 | 0.2 | 2.3 | 0.5 | 0.2 | 1.2 |
| U2-53 | 0.2 | 144 | 0.5 | 0.2 | 0.6 |
| U2-66 | 0.2 | 149 | 0.5 | 0.2 | 0.5 |
| U2-61 | 0.4 | 28 | 0.4 | 0.2 | 1.4 |
| U2-67 | 0.2 | 82 | 0.5 | 0.2 | 0.6 |
| U2-28 | 0.3 | 198 | 1 | 0.2 | 3.2 |
| U2-2 | 0.2 | 127 | 0.5 | 0.2 | 0.5 |
| U2-62 | 0.2 | 47 | 0.5 | 0.2 | 0.6 |
| U2-39 | 0.2 | 205 | 2.6 | 0.6 | 8.3 |
| U2-3 | 0.2 | 168 | 0.9 | 0.2 | 2.5 |
| U2-43 | 0.4 | 185 | 0.8 | 0.2 | 1.7 |
| U2-34 | 0.7 | 125 | 1.2 | 0.3 | 6.4 |
| U2-26 | 0.2 | 242 | 1.5 | 0.3 | 4.7 |
| U2-41 | 0.3 | 186 | 1.2 | 0.2 | 3.3 |
| U2-44 | 0.4 | 248 | 1.2 | 0.2 | 2.2 |
| U2-45 | 0.6 | 248 | 1.4 | 0.2 | 6.4 |
| U2-57 | 0.2 | 201 | 0.7 | 0.2 | 0.5 |
| U2-12 | 0.6 | 1.2 | 1.2 | 0.5 | 1.6 |
| U2-46 | 0.4 | 129 | 1 | 0.2 | 2.5 |
| U2-48 | 0.4 | 273 | 1.3 | 0.3 | 2.1 |
| U2-6 | 0.5 | 108 | 3.9 | 1.5 | 5.9 |
| U2-58 | 0.2 | 277 | 0.9 | 0.2 | 0.4 |
| U2-51 | 0.5 | 176 | 1.1 | 0.2 | 3.6 |

TABLE 3-continued

FACS Analysis Of Anti-HB-EGF Antibody Supernatants (Cohort 2)

| Antibody | CHO control cells vs. HB-EGF-expressing CHO cells | | Cell Lines Endogenously Expressing HB-EGF | | |
|---|---|---|---|---|---|
| | CHO-K1 | CHO-HB-EGF | MDA-MB231 | SCC-9 | COS-7 |
| U2-60 | 0.2 | 3.6 | 0.4 | 0.2 | 0.3 |
| Neg | 0.2 | 0.2 | 0.3 | | |
| Pos (goat aHB) | 0.2 | 80 | 3 | | |

2. Inhibition of HB-EGF-Induced EGFR Tyrosine Phosphorylation

The following protocol was used to identify which anti-HB-EGF antibody preparations inhibit HB-EGF-induced epidermal growth factor receptor tyrosine phosphorylation. Such experiments further characterize the antibodies and help identify which hybridoma cell lines produce antibody that inhibit HB-EGF activity and then should be cloned and expanded.

40000 SCC9 human squamous cancer cells were seeded on a 96-well plate in 100 µl medium. Cells were starved in 60 µl serum free medium for 24 hr. A black Maxisorp 96-well plate was coated with 100 µl anti-EGFR antibody (2 µg/ml) overnight at 4° C. The coating solution was replaced by 300 µl blocking solution (PBS+0.5% BSA) without washing and left to incubate 2 hours at room temperature. 10 µg/ml of IgG2-control (Sigma) or anti-HB-EGF hybridoma-derived antibodies were added to 20 ng/ml HB-EGF (R&D Systems) and preincubated for 30 minutes at 37° C. (volume: 40 µl). Cells were treated with medium alone or with the antibody/ligand solution for 3 minutes at 37° C. The medium was removed and cells were lysed on ice with 100 µl Triton-X-100-based lysis buffer containing 1 mM PMSF, 10 µg/ml Aprotinin, 10 mM NaF and 2 mM Na-Orthovanadate. The blocked Maxisorp plate was washed 6 times with PBS+0.05% Tween-20. 80 µl of the cell lysate was transferred directly to the washed Maxisorp plate and incubated overnight at 4° C. with gentle agitation. The plate was washed 6 times with PBS+0.05% Tween-20, then 100 µl 4G10-biotin (UBI) diluted 1:4000 in dilution buffer (PBS+0.5% BSA+0.05% Tween-20+5 mM EDTA) was added to each well and incubated for 2 hours at room temperature. The plate was washed 6 times with PBS+0.05% Tween20 and 100 µl AP-conjugated streptavidin (UBI) diluted 1:20000 in dilution buffer (PBS+0.5% BSA+0.05% Tween20+5 mM EDTA) was added to each well for 30 minutes at room temperature. The plate was washed 6 times with PBS+0.05% Tween-20 and 100 µl AttoPhos substrate was added to each well. The plate was incubated for up to 3 hours at room temperature in the dark and the developing fluorescence was monitored at 30, 90 and 180 min (Excitation: 430 nm, emission: 580 nm).

The percent inhibition of HB-EGF-induced EGFR tyrosine phosphorylation was calculated by reduction in the amount of phosphorylation observed with IgG2-control (Sigma) by each hybridoma-derived anti-HB-EGF antibody preparation.

Results for the different anti-HB-EGF antibody preparations are provided in FIGS. 23A and 23B. As illustrated, monoclonal antibody preparations U2-18, U2-24, U2-19, U2-42, U2-39, U2-34, U2-45 and U2-6 strongly inhibit EGFR tyrosine phosphorylation.

3. Anti-HB-EGF Antibody Preparations Inhibit LPA-Induced EGFR Phosphorylation

EGFR-dependent signaling pathways can be activated upon stimulation of G-protein-coupled receptors (GPCR). Ligand activation of heterotrimeric G proteins by interaction with a GPCR results in an intracellular signal that induces the extracellular activity of a transmembrane metalloproteinase. Ligands that can activate the GPCR pathway include LPA (lysophosphatidic acid), thrombin, carbachol, bombesin, and endothelin. Such activation leads to extracellular processing of a transmembrane growth factor precursor and release of the mature factor which, directly or through the proteoglycan matrix, interacts with the ectodomain of EGFR and activates it through phosphorylation. See, Prenzel et al., 1999, *Nature* 402:884-888.

The anti-HB-EGF antibody preparations provided herein were tested to ascertain whether they could inhibit EGFR tyrosine phosphorylation induced by the GPCR ligand LPA in COS-7 cells, using the following procedure.

250.000 COS-7 cells were seeded on a 6-well plate, in 2 ml medium and cultured over night. Cells were starved in 1 ml serum free medium for 24 hours. Following preincubation with antibodies (37° C., 1 h), cells were stimulated with 10 µM LPA (37° C., 3 min) and lysed on ice with 400 µl Triton-X-100-based lysis buffer containing 1 mM PMSF, 10 µg/ml Aprotinin, 10 mM NaF and 2 mM Na-Orthovanadate. Following immunoprecipitation of the EGFR (340 µl lysate, 340 µl HNTG, 30 µl Prot. A Sepharose, 1.5 µl αEGFR (108.1, Prenzel et al., 1999, supra)) for 4 hours in the coldroom precipitates were washed 3 times with 500 µl HNTG buffer and run on a 7.5% SDS PAGE. Following transfer on a nitrocellulose membrane (Schleicher & Schuell) the blot was probed with an antibody recognizing phosphotyrosine residues (primary ab 4G10 (1:2000, Upstate biotechnology); secondary anti-mouse Ab 1:10000, Jackson laboratories). Reblot with sheep anti EGFR (Upstate technology) after stripping showed that equal amounts of the receptor were precipitated in each lane.

Figure 24:
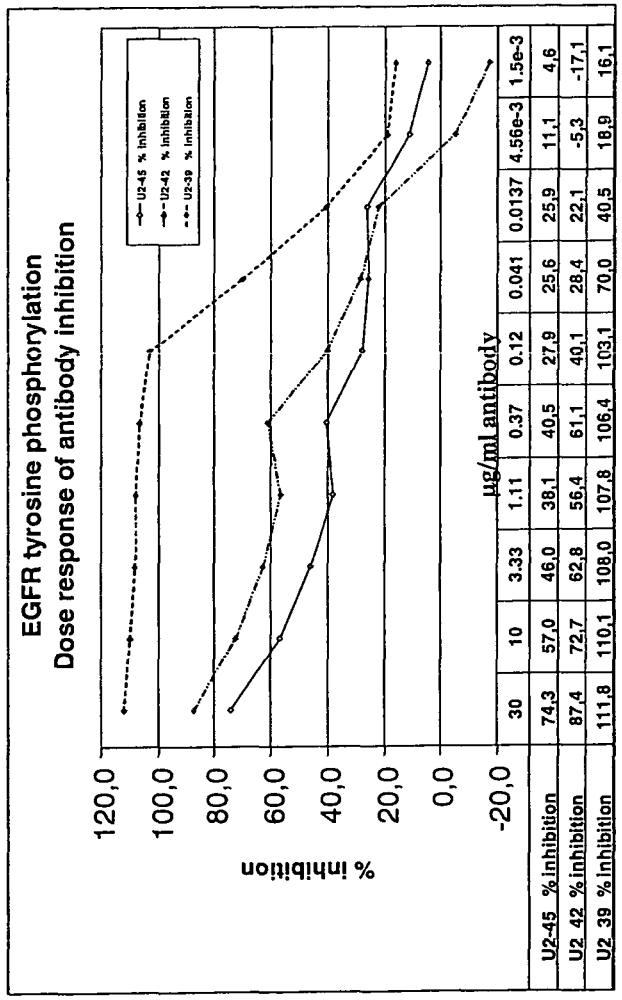
FIG. 24 graphically illustrates dose-dependent inhibition of HB-EGF-induced EGF receptor tyrosine phosphorylation by various antibodies provided herein. Different concentrations of the candidate U2-39, U2-42 and U2-45 antibody preparations were preincubated with HB-EGF prior to stimulation of SCC9 squamous cancer cells and the amount of EGFR tyrosine phosphorylation was detected. As shown, antibody U2-42 and U2-39 achieved up to 111% inhibition. IC50 values determined for the antibodies were 0.167 nM (U2-39), 1 nM (U2-42) and 2 nM (U2-45), respectively.

FIG. 24 provides a western blot illustrating which anti-HB-EGF antibody preparations inhibit LPA-induced EGFR tyrosine phosphorylation. As shown in FIG. 24, the U2-19 and U2-42 anti-HB-EGF antibody preparations strongly inhibited LPA-induced EGFR phosphorylation. The U2-24 anti-HB-EGF antibody preparation inhibited LPA-induced EGFR phosphorylation to a somewhat lesser extent.

E. Example 5

Hybridoma Cloning to Generate Monoclonal Antibodies

Based on the test results observed from experiments described in the preceding Examples, of the 49 original isolates, 43 hybridoma cell lines were selected for cloning by limiting dilution and further characterization of their monoclonal antibody. The lines selected for cloning bound to HB-EGF-expressing cell lines as exhibited by FACS analysis and inhibited HB-EGF-stimulation of EGF receptor tyrosine phosphorylation. For some hybridomas, insufficient antibody was generated to run all the primary screening assays. This subset of hybridomas was advanced to hybridoma cloning as well.

F. Example 6

Further Characterization of Antibody-Related Inhibition of GPCR Induced Tyrosine Phosphorylation of EGFR This Example provides further data showing that several anti-HB-EGF antibody preparations provided herein exhibit dose-dependent inhibition of GPCR-induced EGF receptor tyrosine phosphorylation.

Inhibition by candidate antibody preparations U2-42, U2-39 and U2-45 was examined using different concentrations of these antibody preparations and the following procedure.

150,000 cells (MDA-MB231, PPC1) were seeded on a 12-well plate in 1 ml medium. Cells were starved in 500 µl serum free medium for 24 hr. A black Maxisorp 96-well plate was coated with 100 µl anti-EGFR antibody (2 µg/ml) overnight at 4° C. The coating solution was replaced by 300 µl blocking solution (PBS+0.5% BSA) without washing and left to incubate 2 hours at room temperature. Cells were preincubated with 10 µg/ml anti-HB-EGF Abs for 30 minutes at 37° C. and then treated with the GPCR ligands LPA (10 µM, PPC1 cells) or Thrombin (1 U/ml, MDA-MB231 cells) for 3 minutes at 37° C. The medium was removed and cells were lysed on ice with 200 µl Triton-X-100-based lysis buffer containing 1 mM PMSF, 10 µg/ml Aprotinin, 10 mM NaF and 2 mM Na-Orthovanadate. The blocked Maxisorp plate was washed 6× with PBS+0.05% Tween-20. Cell lysate was transferred directly to a washed Maxisorp plate and incubated overnight at 4° C. with gentle agitation.

The plate was washed 6 times with PBS+0.05% Tween-20, then 100 µl 4G10-biotin (UBI) diluted 1:4000 in dilution buffer (PBS+0.5% BSA+0.05% Tween-20+5 mM EDTA) was added to each well and incubated for 2 hours at room temperature. The plate was washed 6 times with PBS+0.05% Tween-20 and 100 µl AP-conjugated streptavidin (UBI) diluted 1:20000 in dilution buffer (PBS+0.5% BSA+0.05% Tween-20+5 mM EDTA) was added to each well for 30 minutes at room temperature. The plate was washed 6 times with PBS+0.05% Tween-20 and 100 µl Attophos substrate was added to each well. The plate was incubated for 3 hours at room temperature in the dark and the developing fluorescence was monitored at 30, 90 and 180 min (Excitation: 430 nm, emission: 580 nm).

Figure 26:
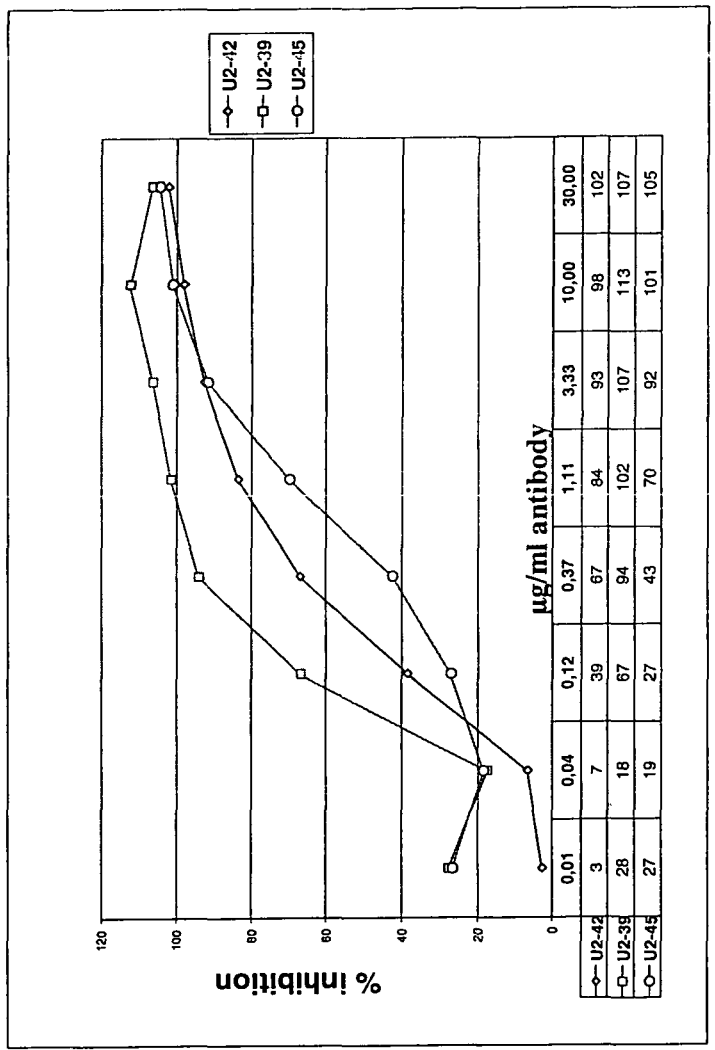
FIG. 26 illustrates dose-dependent inhibition of LPA-induced EGFR tyrosine phosphorylation via TMPS in PPC-1 cells by anti-HB-EGF antibody preparations. PPC-1 cells were incubated with candidate U2-42, U2-39 and U2-45 antibody preparations and the amount of EGFR tyrosine phosphorylation following LPA stimulation was detected using a procedure described in Example 4. As shown, antibodies U2-42, U2-39 and U2-45 achieved 100% inhibition.

As shown in FIG. 26, inhibition of LPA-induced EGFR tyrosine phosphorylation was dose dependent—greater inhibition of EGFR tyrosine phosphorylation was observed as the amount of anti-HB-EGF antibody was increased.

Figure 25:
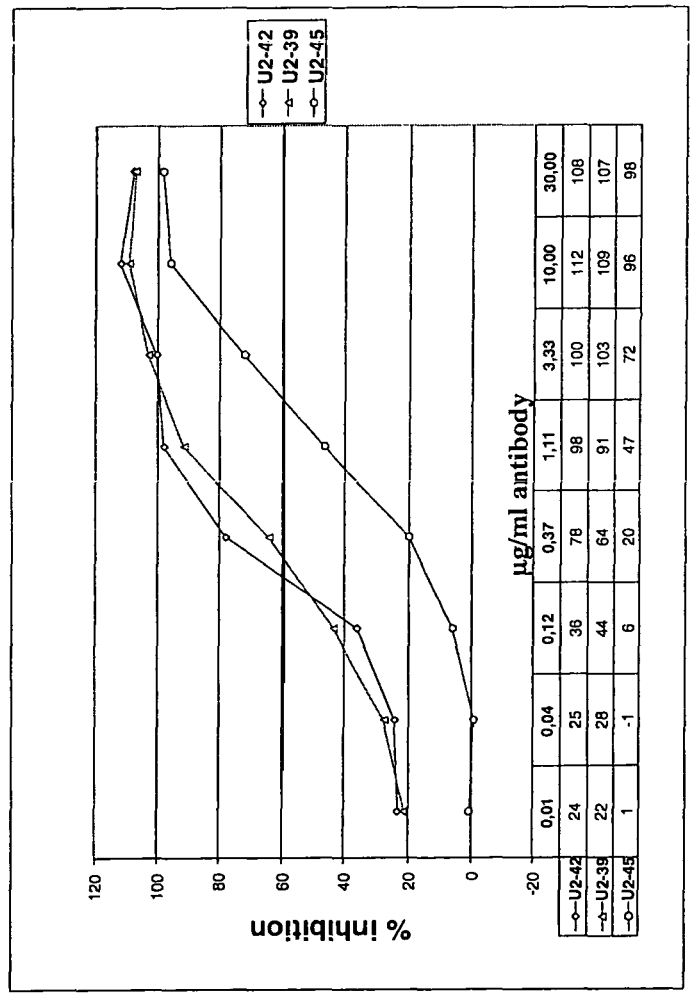
FIG. 25 graphically illustrates dose-dependent inhibition of thrombin-induced EGFR phosphorylation via IMPS in MDA-MB231 cells by anti-HB-EGF antibody preparations. MDA-MB231 cells were incubated with candidate U2-42, U2-39 and U2-45 antibody preparations in the presence of thrombin and the amount of EGFR tyrosine phosphorylation was detected using a procedure described in Example 6. As shown, antibodies U2-42 and U2-39 achieving 100% inhibition.

FIG. 25 illustrates that candidate antibody preparations U2-42, U2-39 and U2-45 also effectively inhibit thrombin-induced EGFR phosphorylation in MDA-MB231 cells. A dosage dependent inhibition is observed, with increased inhibition as more anti-HB-EGF antibody is added. FIG. 26 illustrates that inhibition of LPA-induced EGFR tyrosine phosphorylation in PPC-1 cells by anti-HB-EGF antibody preparations provided herein is dose dependent. As shown, greater inhibition of EGFR tyrosine phosphorylation was detected as the amount of anti-HB-EGF antibody was increased.

G. Example 7

Inhibition of GPCR-Induced MDA-MB231 Cell Migration by Human Anti-HB-EGF Antibodies Transmigration experiments were performed in order to investigate whether the antibodies provided herein block cell migration induced by the GPCR ligand Sphingosine-1-phosphate.

Serum-starved human breast cancer MDA-MB231 cells were preincubated with the indicated antibody to the cell suspension for 45 min at 37° C. Thereafter, 500 ml cell suspension (50,000 cells) was placed in the top chamber of collagen I-coated transwells (BD Falcon, 8 µm pores). 750 ml medium (MEM, amino acids, Na-Pyruvate, Pen.-Strept., 0.1% BSA) alone or containing the GPCR ligand Sphingosine-1-phosphate (R&D Systems) was used in the bottom chamber. After migration for 8 hours at 37° C. cells were fixed, stained with DAPI and cell nuclei were counted for statistical evaluation.

Figure 27:
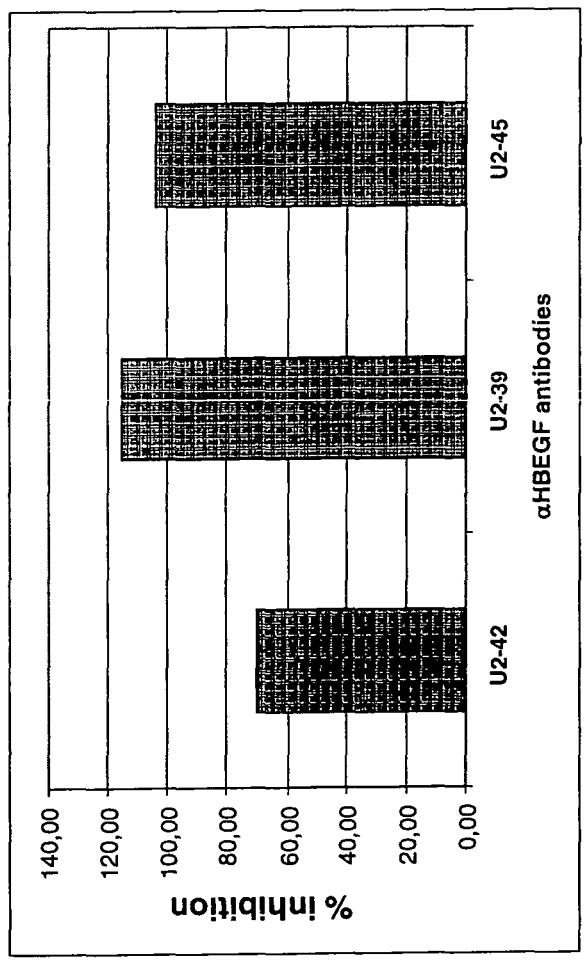
FIG. 27 illustrates that anti-HB-EGF antibody preparations inhibited by up to 100% the induction of MDA-MB231 breast cancer cell migration by sphingosine-1-phosphate. Candidate anti-HB-EGF antibody preparations U2-42, U2-39 and U2-45 were tested for cell migration inhibition using of collagen I-coated transwells (BD Falcon, 8 μm pores). As shown, anti-HB-EGF antibody preparation U2-42 inhibited sphingosine-1-phosphate-induced MDA-MB231 cell migration by about 70% while the U2-39 and U2-45 anti-HB-EGF antibody preparations inhibited MDA-MB231 cell migration by about 100%. Thus, the anti-HB-EGF antibodies provided herein strongly inhibit MDA-MB231 cell migration.

The results for these MDA-MB231 cell migration assays using candidate anti-HB-EGF antibody preparations U2-42, U2-39 and U2-45 are provided in FIG. 27. As shown, anti-HB-EGF antibody preparation U2-42 inhibited MDA-MB231 cell migration by about 70%; anti-HB-EGF antibody preparation U2-45 inhibited MDA-MB231 cell migration by about 100%; and anti-HB-EGF antibody preparation U2-39 inhibited MDA-MB231 cell migration by about 100%. Hence, the ability of these anti-HB-EGF antibodies to inhibit MDA-MB231 cell migration is substantial.

H. Example 8

Inhibition of HB-EGF-Induced Migration of MCF-7 Cells by Human Anti-HB-EGF Antibodies Transmigration experiments were performed in order to investigate whether the antibodies provided herein block cell migration that would otherwise be directly induced by HB-EGF. The results of these tests highlight which antibody preparations may be use for development as anti-metastatic cancer agents.

A 500 ml cell suspension of serum-starved human breast cancer MCF7 cells (50,000 cells) was placed in the top chamber of collagen I-coated transwells (BD Falcon, 8 µm pores). Aliquots of 750 ml medium (MEM, amino acids, Na-pyruvate, Pen.-Strept., 0.1% BSA) alone or containing 20 ng/ml HB-EGF (R&D Systems) in the presence or absence of 10 µg/ml HB-EGF antibodies were placed in the bottom chamber. After incubation and migration for 8 hours at 37° C., cells were fixed, stained with DAPI and cell nuclei were counted for statistical evaluation.

Figure 28:
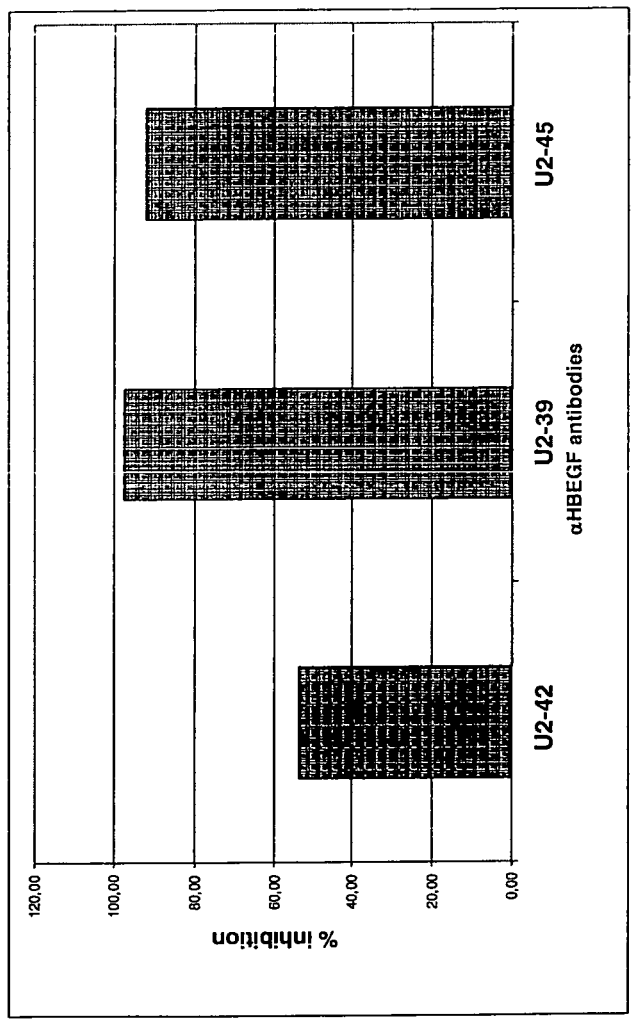
FIG. 28 graphically illustrates that HB-EGF-induced migration of MCF-7 breast cancer cells is inhibited by three anti-HB-EGF antibody preparations (the U2-42, the U2-39 and the U2-45 monoclonal antibody preparations).

The results for these migration assays using candidate anti-HB-EGF antibody preparations U2-42, U2-39 and U2-45 are provided in FIG. 28. As shown, anti-HB-EGF antibody preparation U2-42 inhibited MCF-7 cell migration by about 55%; anti-HB-EGF antibody preparation U2-45 inhibited MCF-7 cell migration by about 93%; and anti-HB-EGF antibody preparation U2-39 inhibited MCF-7 cell migration by about 98%. Hence, the ability of these anti-HB-EGF antibodies to inhibit MCF-7 cell migration is substantial.

I. Example 9

Characteristics of Top 10 Anti-HB-EGF Antibodies

A summary of results is provided in TABLE 4, infra, for top 10 hybridoma-derived antibody preparations in GPCR-induced triple membrane-passing signal (IMPS) experiments. The TMPS experiments involved LPA-stimulation in SCC9 cells, thrombin stimulation in MDA-MB231 cells, LPA stimulation of SkOV-8 cells and Sphingosine-1-phosphate migration of MDA-MB231 cells. The data provided represent the percent inhibition of the TMPS transactivation signal that was observed when antibody preparations were used in the assays compared to the same assay when no antibody was present. The top three antibodies of each experiment are highlighted in bold letters.

TABLE 4

| | Percent Inhibition of TMPS Transactivation Signal | | | | | |
|---|---|---|---|---|---|---|
| | TMPS | | | | | Migration |
| Ab | SCC9.3 | MDA-MB231 | MDA-MB231 | SkoV-8 | SkoV-8 | MDA-MB231 |
| U2-39 | 56.9 | 126.6 | 131.1 | 130.7 | 65.5 | 115 |
| U2-45 | 58.5 | 136.8 | 95.7 | 99.4 | 75.1 | 104 |
| U2-42 | 62.8 | 123.2 | 125.6 | 110.7 | 73.1 | 69.9 |
| U2-34 | 50.6 | 109.5 | 93.6 | 95.1 | 73 | 99.6 |
| U2-46 | 36.6 | 88.1 | 77.5 | 80.5 | 76.1 | n.d. |
| U2-19 | n.d. | n.d. | n.d. | n.d. | n.d. | 85 |
| U2-26 | n.d. | 143 | 91.8 | 106.1 | 31.4 | 55.9 |
| U2-51 | n.d. | n.d. | n.d. | n.d. | n.d. | 85.3 |
| U2-15 | n.d. | 121.7 | 92.6 | 87 | 17.6 | 45.5 |
| U2-22 | n.d. | 74.2 | 94.3 | 64.4 | 18.2 | n.d. |

J. Example 10

Inhibition of HB-EGF-Induced HER4 Tyrosine Phosphorylation by Human Anti-HB-EGF Antibodies This Example shows that anti-HB-EGF antibody preparations inhibit HB-EGF induced tyrosine phosphorylation of HER4. The following procedures were employed to assess the effects of anti-HB-EGF antibodies on HER4 tyrosine phosphorylation.

125,000 cells T47D human breast cancer cells were seeded on a 24-well plate in 500 µl medium. Cells were starved in 200 µl serum free medium for 24 hr. An R&D Systems Human Phospho-ErbB4 ELISA-Kit was used for detection of HER4 tyrosine phosphorylation. A clear Maxisorp 96-well plate was coated with 100 µl mouse anti-human-ErbB4 antibody (Capture Antibody 1 µg/ml) overnight at room temperature. The coated Maxisorp plate was washed 6 times with PBS+ 0.05% Tween-20, the washing solution was replaced by 300 µl blocking solution (PBS+0.5% BSA) and incubated 2 hours at room temperature. 50 µl serum-free medium with 5×-concentration of anti-HB-EGF Abs (10 µg/ml) was incubated with 5×-concentration HB-EGF (20 ng/ml) for 30 min at 37° C., then added to each well (in duplicate). The medium was removed and cells were lysed on ice with 200 µl Triton-X-100-based lysis buffer containing 0.1 mM PMSF, 10 µg/ml Aprotinin, 10 mM NaF and 2 mM Na-Orthovanadate. The blocked Maxisorp plate was washed 3 times with PBS+0.05% Tween-20. Cell lysate was transferred directly to a washed Maxisorp plate and incubated overnight at 4° C. with gentle agitation. The plate was washed 6 times with PBS+0.05% Tween-20, then 100 µl anti-Phospho-tyrosine-HRP (Detection Antibody 600 ng/ml) diluted in dilution buffer (PBS+0.5% BSA+0.05% Tween-20+5 mM EDTA) was added to each well and incubated for 2 hours at room temperature. The plate was washed 6 times with PBS+0.05% Tween20 and 100 µl Tetramethylbenzidine (TMB, Calbiochem) was added to each well for 20 minutes at room temperature. The reaction was stopped by addition of 50 µl 1 M $H_2SO_4$ and the absorbance was read at 450 nm (Thermo Lab Systems plate reader).

Figure 29:
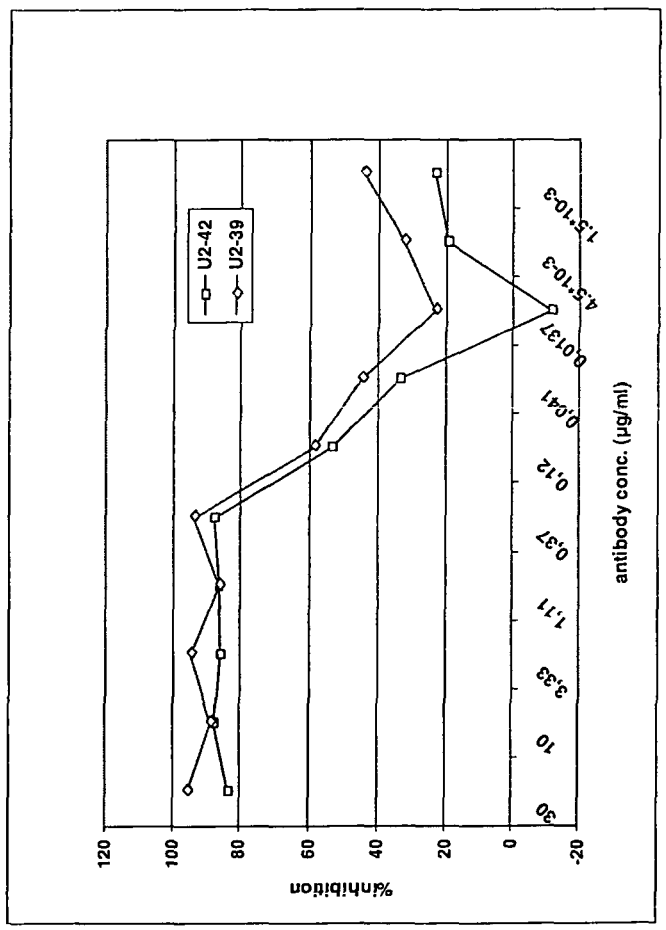
FIG. 29 illustrates the dose-dependent inhibition of HB-EGF-induced tyrosine phosphorylation of HER4 by anti-HB-EGF antibody preparations. U2-42.1 or U2-39.1 anti-HB-EGF antibody preparations were incubated with HB-EGF prior to stimulation and detection of HER4 tyrosine phosphorylation. As shown, 100% inhibition of HER4 tyrosine phosphorylation was observed. Note that the amount of antibody shown on the x-axis decreases logarithmically.

The results are shown in FIG. 29. As illustrated, increasing concentrations of U2-42.1 or U2-39.1 anti-HB-EGF antibody preparations led to increased inhibition of HB-EGF-induced HER4 phosphorylation.

K. Example 11

Monoclonal Antibody Cross-Reactivity

This Example provides further data showing cross reactivity of anti-HB-EGF antibody preparations for the cyno HB-EGF, mouse HB-EGF and the related EGF-like growth factor Amphiregulin. Following cloning of the monkey and mouse form of HB-EGF, each expression construct was transfected in HEK293 cells and anti-HB-EGF antibodies were tested on their ability to bind these proteins in a FACS experiment. Amphiregulin cross reactivity was tested by ELISA format assay.

1. Cloning Cyno HB-EGF

In the present study, cyno HB-EGF plasmids were prepared. The cyno HB-EGF cDNA was cloned by polymerase chain reaction (PCR) from cyno kidney cDNA with primers based on the sequence of cyno HB-EGF.

The primers used for the amplification of cyno HB-EGF were as follows:

```
                                    (SEQ ID NO: 1078)
Forward primer: 5'-GGG TTA ACG CCA CCA TGA AGC
                TGC TGC CGT CG-3'

(SEQ ID NO: 1079)
Reverse primer: 5'-CCG CTC GAG GTG GGA ATT AGT
                CAT GCC C-3'
```

The PCR product was digested with Hpa1 and Xho1 and ligated into pcDNA3.1 digested with Hind3. After purification, cyno HB-EGF plasmids were transformed into DH5α bacterial cells and multiplied under ampicilin selection. The plasmid was then highly expressed in ampicilin selection media using a single transformed colony. After purifying using a commercially available DNA-purification kit, cyno HB-EGF plasmids were transiently transfected in HEK293T cells.

2. Cloning Mouse HB-EGF

In the present study, mouse HB-EGF plasmids were prepared. The mouse HB-EGF cDNA was cloned by polymerase chain reaction (PCR) from mouse lung cDNA with primers based on the sequence of mouse HB-EGF.

The primers used for the amplification of mouse HB-EGF were as follows:

```
                                    (SEQ ID NO: 1080)
Forward primer: 5'-GGA ATT CGC CAC CAT GAA GCT
                GCT GCC GTC G-3'

(SEQ ID NO: 1081)
Reverse primer: 5'-CCG CTC GAG GTG GGA GCT AGC
                AGC CAC GCC-3'
```

The PCR product and pcDNA3.1 vector DNA were digested with EcoR1 and Xho1 and ligated. After purification, mouse HB-EGF plasmids were transformed into DH5α bacterial cells and multiplied under ampicillin selection. The plasmid was then highly expressed in ampicillin selection media using a single transformed colony. After purifying using a commercially available DNA-purification kit, mouse HB-EGF plasmids were transiently transfected in HEK293T cells.

3. Transfection and Expression of Cyno and Mouse HB-EGF

To screen for cross-reactivity of antibodies provided herein HEK293T cells were transiently transfected with either cyno or mouse HB-EGF plasmids using a Ca-phosphate method and subsequently analysed by FACS analysis.

Therefore, 30 hours before transfection, 3×106 HEK293T-cells were seeded in 16 ml on a 15 cm-cell culture plate and incubated at 7% $CO_2$ and 37° C. 32 µg DNA of either cyno or mouse HB-EGF DNA or empty vector in 720 µl $ddH_2O$ were mixed with 2.5 M $CaCl_2$ and 2×BBS (pH6.96) and incubated at room temperature for 10 minutes. After incubation, the solution was added drop wise onto the cells and incubated at 3% $CO_2$ and 37° C. for 8 hours. After soaking the media, the cells were incubated with fresh growing media at 7% $CO_2$ and 37° C. for 24 hours.

4. FACS Analysis was Performed to Screen for Cross-Reactivity of the Antibodies

Therefore, $2\times10^5$ transfected cells were harvested with 10 mM EDTA in PBS, resuspended in FACS-buffer (PBS, 3% FCS, 0.4% azide) and seeded on a 96-well round bottom plate. After centrifugation for 3 min at 1000 rpm to remove supernatant, the cells were resuspended in anti-HB-EGF antibody dilution (100 µl/well) and incubated at 4° C. for 45 min. The cells were washed twice with FACS buffer and resuspended with secondary antibody (100 µl/well) donkey-anti-human-PE (Jackson) diluted 1:100 in FACS buffer. The cell suspensions were incubated at 4° C. in the dark for 30 min, washed twice with FACS buffer and analyzed (FACS, Beckman Coulter).

FIG. 30A shows that three mAb preparations cross-react with pro-HB-EGF from Cynomolgus monkeys.

FIG. 30B shows that the U2-45 mAb preparation cross-reacts with mouse HB-EGF as detected by FACS analysis. Further testing showed that antibodies U2-46 and U2-51 were also detecting mouse HB-EGF. However, the antibody U2-45.1 was only very weakly (5-10%) neutralizing mouse HB-EGF induced tyrosine phosphorylation of the EGFR.

5. Protocol for Amphiregulin Cross Reactivity ELISA Assay

Different concentrations of Amphiregulin (R & D systems, conc. 1 ng/ml, 10 ng/ml, 100 ng/ml in PBS) were coated overnight at 4° C. in a 96-well plate (Nunc, Maxisorp). Following plate wash (6-times) with washing buffer (PBS+ 0.05% Tween 20; 150 µl per well), the plate was incubated with blocking buffer (PBS+0.5% BSA, 100 µl/well) for 4 hours at room temperature. The plate was washed 6-times with washing buffer. As primary antibody 5 µg/ml purified human anti-HB-EGF antibodies in Ab dilution buffer (PBS containing 0.5% BSA, 0.05% Tween 20, 5 mM EDTA) were used and incubated for 90 minutes at room temperature. The plate was washed 6-times with washing buffer and a secondary anti human-POD (Dianova) antibody was added (1:10 000 in PBS, 0.5% BSA, 0.05% Tween 20, 5 mM EDTA) and incubated for 60 minutes at room temperature.

The plate was washed 6-times with washing buffer and the TMB substrate (Merck Biosciences) was added for 15 minutes at room temperature. After stopping the development of the blue color by adding 100 µl of 250 mM HCl the absorbance was measured at 450 nm with a plate reader (Thermo labsystems).

FIG. 30C shows that antibody U2-45 and weakly antibody U2-46 bind to Amphiregulin as determined by an ELISA format assay. The U2-45 mAb binds Amphiregulin but the U2-45.1 $K_D$ for Amphiregulin was only 8 nM (versus 0.043 nM for HB-EGF). The U2-45.1 mAb was also non-neutralizing for AR.

L. Example 12

Kinetic Exclusion Assay Analysis of $K_d$ Values for Anti-HB-EGF Mabs U2-42.2, U2-39.1, U2-45.3, U2-26.2, And U2-34.1

The $K_D$s of mAbs U2-42.2, U2-39.1, U2-45.3, and U2-26.2, and U2-34.1 binding to human HB-EGF, were determined using KinExA technology. For this purpose, a KinExA 3000 instrument was utilized. For all mAb titrations, 50 mg of azlactone beads were coupled with HB-EGF (~29 µg) in 50 mM sodium carbonate buffer, pH 9.0 overnight at 4° C. After conjugation of HB-EGF to the beads, the beads were centrifuged and washed once with blocking buffer (1 M Tris buffer, pH 8.3, 10 mg/ml BSA) and centrifuged again, and then incubated in blocking buffer for one to two hours at ~23° C. in order to block any remaining reactive azlactone groups present on the surface of the beads. After blocking, the beads were transferred to a standard KinExA bead vial and placed on the instrument.

MAb U2-42.2: A dual curve analysis was performed to determine the $K_D$. Twelve solutions containing a nominal mAb binding site concentration of 37 pM were titrated with increasing concentrations of HB-EGF for the $K_D$-controlled titration, and 1110 pM binding site was titrated in the mAb-controlled titration curve. Each solution had a total volume of 10 ml ($K_D$-controlled) or 2 ml (mAb-controlled) and was allowed to equilibrate for 30-36 hours ($K_D$-controlled) or 6 hours (mAb-controlled) at ~23° C. All solutions for the titration were prepared using volumetric glassware and the HB-EGF concentrations varied from 10.5 nM to 205 fM. The instrument method used for the analysis of these solutions consisted of a bead packing step in which the beads were packed into a glass capillary, and the equilibrated solutions were flowed through the bead column at 0.25 ml/min for 10 min (2.5 ml, $K_D$-controlled) or 1 min (0.25 ml, mAb-controlled) in triplicate. Subsequently, a fluorescently labeled cy-5 goat anti-human (Fc specific) polyclonal antibody at 3.4 nM ($K_D$-controlled) or 1.1 nM (mAb-controlled) was flowed through the bead pack for 2 min at 0.5 ml/min to label the free mAb binding site captured on the beads. The fluorescence emission from the bead pack was measured at 670 nm with excitation at 620 nm.

The resulting fluorescence measurements were converted into %-free mAb binding site versus total antigen concentration as standardly done with the accompanying KinExA software package (version 1.0.3). The dual titration curves were fit with the KinExA software to a 1:1 equilibrium isotherm with drift correction factors included.

The value of the $K_D$ that fit the data optimally was 53 pM with low and high 95% confidence limits at 34 pM and 81 pM, respectively.

MAb U2-39.1: A $K_D$-controlled titration curve was performed to determine the $K_D$. Twelve solutions containing a nominal mAb binding site concentration of 55 pM were titrated with increasing concentrations of HB-EGF. Each solution had a total volume of 10 ml and was allowed to equilibrate for 30-36 hours at ~23° C. All solutions for the titration were prepared using volumetric glassware and the HB-EGF concentrations varied from 10.5 nM to 205 fM. The instrument method used for the analysis of these solutions consisted of a bead packing step in which the beads were packed into a glass capillary, and the equilibrated solutions were flowed through the bead column at 0.25 ml/min for 10 min (2.5 ml) in triplicate. Subsequently, a fluorescently labeled cy-5 goat anti-human (Fc specific) polyclonal antibody at 3.4 nM was flowed through the bead pack for 2 min at 0.5 ml/min to label the free mAb binding site captured on the beads. The fluorescence emission from the bead pack was measured at 670 nm with excitation at 620 nm. The resulting fluorescence measurements were converted into % free mAb binding site versus total antigen concentration using the accompanying KinExA software package (version 1.0.3). Owing to ligand nonspecific binding to the bead pack, the titration curve was fit with the KinExA software to a 1:1 equilibrium isotherm with a term for ligand nonspecific binding included.

The value of the $K_D$ that fit the data optimally was 7.8 pM with low and high 95% confidence limits at 5.6 pM and 11 pM, respectively.

MAb U2-45.3: A dual curve analysis was performed to determine the $K_D$. Twelve solutions containing a nominal mAb binding site concentration of 40 pM were titrated with increasing concentrations of HB-EGF for the $K_D$-controlled titration, and 1060 pM binding was titrated in the mAb-controlled titration curve. Each solution had a total volume of 10 ml ($K_D$-controlled) or 2 ml (mAb-controlled) and was allowed to equilibrate for 30-36 hours ($K_D$-controlled) or 6 hours (mAb-controlled) at ~23° C. All solutions for the titration were prepared using volumetric glassware and the HB-EGF concentrations varied from 5.25 nM to 102 fM. The instrument method used for the analysis of these solutions consisted of a bead packing step in which the beads were packed into a glass capillary, and the equilibrated solutions were flowed through the bead column at 0.25 ml/min for 10 min (2.5 ml, $K_D$-controlled) or 1 min (0.25 ml, mAb-controlled) in triplicate. Subsequently, a fluorescently labeled cy-5 goat anti-human (Fc specific) polyclonal antibody at 3.4 nM ($K_D$-controlled) or 1.1 nM (mAb-controlled) was flowed through the bead pack for 2 min at 0.5 ml/min to label the free mAb binding site captured on the beads. The fluorescence emission from the bead pack was measured at 670 nm with excitation at 620 nm. The resulting fluorescence measurements were converted into % free mAb binding site versus total antigen concentration as standardly done with the accompanying KinExA software package (version 1.0.3). The dual titration curves were fit with the KinExA software to a 1:1 equilibrium isotherm with drift correction factors included.

The value of the $K_D$ that fit the data optimally was 43 pM with low and high 95% confidence limits at 27 pM and 65 pM, respectively.

MAb U2-26.2: A dual curve analysis was performed to determine the $K_D$. Twelve solutions containing a nominal mAb binding site concentration of 41 pM were titrated with increasing concentrations of HB-EGF for the $K_D$-controlled titration, and 1060 pM binding site was titrated in the mAb-controlled titration curve. Each solution had a total volume of 10 ml ($K_D$-controlled) or 2 ml (mAb-controlled) and was allowed to equilibrate for 30-36 hours ($K_D$-controlled) or 6 hours (mAb-controlled) at ~23° C. All solutions for the titration were prepared using volumetric glassware and the HB-EGF concentrations varied from 2.63 nM-51.4 fM ($K_D$-controlled) and 5.26 nM-103 fM (mAb-controlled). The instrument method used for the analysis of these solutions consisted of a bead packing step in which the beads were packed into a glass capillary, and the equilibrated solutions were flowed through the bead column at 0.25 ml/min for 10 min (2.5 ml, $K_D$-controlled) or 1 min (0.25 ml, mAb-controlled) in triplicate. Subsequently, a fluorescently labeled cy-5 goat anti-human (Fc specific) polyclonal antibody at 3.4 nM ($K_D$-controlled) or 1.1 nM (mAb-controlled) was flowed through the bead pack for 2 min at 0.5 ml/min to label the free mAb binding site captured on the beads. The fluorescence emission from the bead pack was measured at 670 nm with excitation at 620 nm. The resulting fluorescence measurements were converted into % free mAb binding site versus total antigen concentration as standardly done with the accompanying KinExA software package (version 1.0.3). The dual titration curves were fit with the KinExA software to a 1:1 equilibrium isotherm with drift correction factors included.

The value of the $K_D$ that fit the data optimally was 61 pM with low and high 95% confidence limits at 37 pM and 100 pM, respectively.

MAb U2-34.1: A $K_D$-controlled titration curve was performed to determine the $K_D$. Twelve solutions containing a nominal mAb binding site concentration of 40 pM were titrated with increasing concentrations of HB-EGF. Each solution had a total volume of 10 ml and was allowed to equilibrate for 30-36 hours at ~23° C. All solutions for the titration were prepared using volumetric glassware and the HB-EGF concentrations varied from 5.26 nM-103 fM. The instrument method used for the analysis of these solutions consisted of a bead packing step in which the beads were packed into a glass capillary, and the equilibrated solutions were flowed through the bead column at 0.25 ml/min for 10 minutes (2.5 ml) in triplicate. Subsequently, a fluorescently labeled cy-5 goat anti-human (Fc specific) polyclonal antibody at 5.1 nM was flowed through the bead pack for 2 minutes at 0.5 ml/min to label the free mAb binding site captured on the beads. The fluorescence emission from the bead pack was measured at 670 nm with excitation at 620 nm. The resulting fluorescence measurements were converted into % free mAb binding site versus total antigen concentration as standardly done with the accompanying KinExA software package (version 1.0.3). Owing to ligand nonspecific binding to the bead pack, the titration curve was fit with the KinExA software to a 1:1 equilibrium isotherm with a term for ligand nonspecific binding included.

The value of the $K_D$ that fit the data optimally was 59 pM with low and high 95% confidence limits at 32 pM and 87 pM, respectively.

M. Example 13

Determination of Antibody Affinity Scatchard Analysis

Affinity measurements of antibodies provided herein were performed by indirect FACS Scatchard analysis. To perform this analysis $2 \times 10^5$ cells of interest were harvested with 10 mM EDTA in PBS, resuspended in FACS-buffer (PBS, 3% FCS, 0.4% azide) and seeded on a 96-well round bottom plate. After centrifugation for 3 min at 1000 rpm to remove supernatant, the cells were resuspended in anti-HB-EGF antibody dilution (100 µl/well) starting with 20 µg/ml, diluted in 1:2 dilution steps. Cell suspensions were incubated at 4° C. for 45 min, washed twice with FACS buffer and resuspended with secondary antibody (100 µl/well) donkey-anti-human-PE (Jackson) diluted 1:100 in FACS buffer. The cell suspensions were incubated at 4° C. in the dark for 30 min, washed twice with FACS buffer and analyzed (FACS, Beckman Coulter).

According to the FACS Scatchard analysis, the fluorescence mean was calculated for each measurement. Background fluorescence of cells without HB-EGF antibodies was subtracted from each fluorescence mean. Scatchard plot with x-value=fluorescence mean and y-value=fluorescence mean/concentration of mAb (nM) was generated. The $K_D$ was taken as the absolute value of 1/m of linear equation.

TABLE 5

FACS Scatchard Determined Affinities Of Antibodies U2-42 And U2-39 On Three Different Human Cancer Cell Lines

| Antibody | Cell line | | |
|---|---|---|---|
| | DLD-1 | NCI-ADR | MDA-MB231 |
| U2-42 | 4.88 | 5.98 | 0.41 |
| U2-39 | 9.05 | 7.63 | 6.21 |

N. Example 14

Kinetic Exclusion Assay Analysis of $K_d$ Values for Anti-HB-EGF Mab U2-45.3 Binding to Amphiregulin A $K_D$-controlled titration curve was performed to determine the $K_D$. Twelve solutions containing a nominal mAb binding site concentration of 4.4 nM were titrated with increasing concentrations of Amphiregulin. Each solution had a total volume of 10 ml and was allowed to equilibrate for 30-36 hours at ~23° C. All solutions for the titration were prepared using volumetric glassware and the Amphiregulin concentrations varied from 1.23 µM to 24 pM. The instrument method used for the analysis of these solutions consisted of a bead packing step in which the beads were packed into a glass capillary, and the equilibrated solutions were flowed through the bead column at 0.25 ml/min for 1 minute (0.25 ml) in triplicate. Subsequently, a fluorescently labeled cy-5 goat anti-human (Fc specific) polyclonal antibody at 684 pM was flowed through the bead pack for 2 minutes at 0.5 ml/min to label the free mAb binding site captured on the beads. The fluorescence emission from the bead pack was measured at 670 nm with excitation at 620 nm. The resulting fluorescence measurements were converted into % free mAb binding site versus total antigen concentration as standardly done with the accompanying KinExA software package (version 1.0.3). Owing to ligand nonspecific binding to the bead pack, only one replicate out of the three collected at each concentration (the highest three 2-fold Amphiregulin concentrations were excluded from the analysis) could be analyzed and fit with the KinExA software to a 1:1 equilibrium isotherm.

The value of the $K_D$ that fit the data optimally was 5.0 nM with low and high 95% confidence limits at 3.1 nM and 7.7 nM, respectively.

O. Example 15

Selection Criterion for Top Antibody Preparations

The following criteria were used to identify the top antibody preparations: potency in inhibiting TMPS, potency in directly inhibiting HB-EGF as measured by observing the degree to which the antibodies inhibited tyrosine phosphorylation of EGF receptor and HER4, the affinity of the antibodies for HB-EGF, the cross-reactivity of the antibodies for other molecules and the characteristics of the epitopes.

P. Example 16

Anti-Hb-Egf Antibodies Inhibit HB-EGF Stimulation of Huvec Cellular Proliferation and Tube Formation This Example illustrates that while HB-EGF stimulates human vascular endothelial cell (HUVEC) proliferation, anti-HB-EGF antibodies provided herein inhibit basal HUVEC cell proliferation. Also, as shown by this Example, anti-HB-EGF antibodies inhibit HUVEC tube formation, which is an in vitro model for neo-angiogenesis. Antibody preparations that inhibit HUVEC proliferation and/or angiogenesis are useful not only for treating cancer but also for treating non-cancerous conditions involving undesired angiogenesis (e.g., diabetic retinopathy).

1. Procedures: Determination of HB-EGF Expression on HUVEC Cells by Flow Cytometry HB-EGF expression on human endothelial cells was determined by FACS analysis. Therefore, $2 \times 10^5$ cells of interest were harvested with 10 mM EDTA in PBS, resuspended in FACS-buffer (PBS, 3% FCS, 0.4% azide) and plated on a 96-well round bottom plate. After centrifugation for 3 min at 1000 rpm, supernatant was removed, the cells were resuspended in anti-HB-EGF antibody dilution (100 µl/well, 10 µg/ml anti-HB-EGF antibody) and incubated at 4° C. for 45 min. The cells were washed twice with FACS buffer and resuspended with secondary antibody (100 µl/well) anti-human-PE (Jackson) diluted 1:100 in FACS buffer. The cell suspensions were incubated at 4° C. in the dark for 30 min, washed twice with FACS buffer and analyzed (FACS, Beckman Coulter).

To test for the effects of anti-HB-EGF antibodies on HUVEC proliferation, approximately 5000 HUVEC cells were seeded into each of 48 wells containing media with EGM-2, hydrocortisone, ascorbic acid, gentamycin-amphothericin and 2% FCS containing bFGF, VEGF, EGF and IGF-1 (Cambrex). After incubating the cells overnight at 37 C, the cells were washed twice with PBS containing 0.5% FCS. The cells were then starved 8 h in EGM-2, 0.5% FCS without supplementation of growth factors. HB-EGF or anti-HB-EGF antibody preparations were added in 500 µl starvation media.

Cells were then cultured for an additional 60 hours, trypsinized and counted.

To test for the effects of anti-HB-EGF antibodies on HUVEC tube formation, 200 µl growth factor reduced matrigel (BD biosciences) was plated on 48 wells. 250 µl HUVEC medium was added per 48 well (EBM-2+hydrocortisone+ascorbic acid gentamycin-amphothericin+0.25% FCS from Cambrex). Following preincubation for 20 min, 20,000 HUVEC cells in 50 µl medium+0.25% FCS containing HB-EGF (10 ng/ml) or U2-42, U2-39 or U2-45 anti-HB-EGF antibodies (10 µg/ml) were added. Tube formation was monitored by obtaining photomicrographs of representative areas of the culture wells. For a quantitative analysis closed areas of HUVEC tubes were counted.

2. Results

Figure 30:
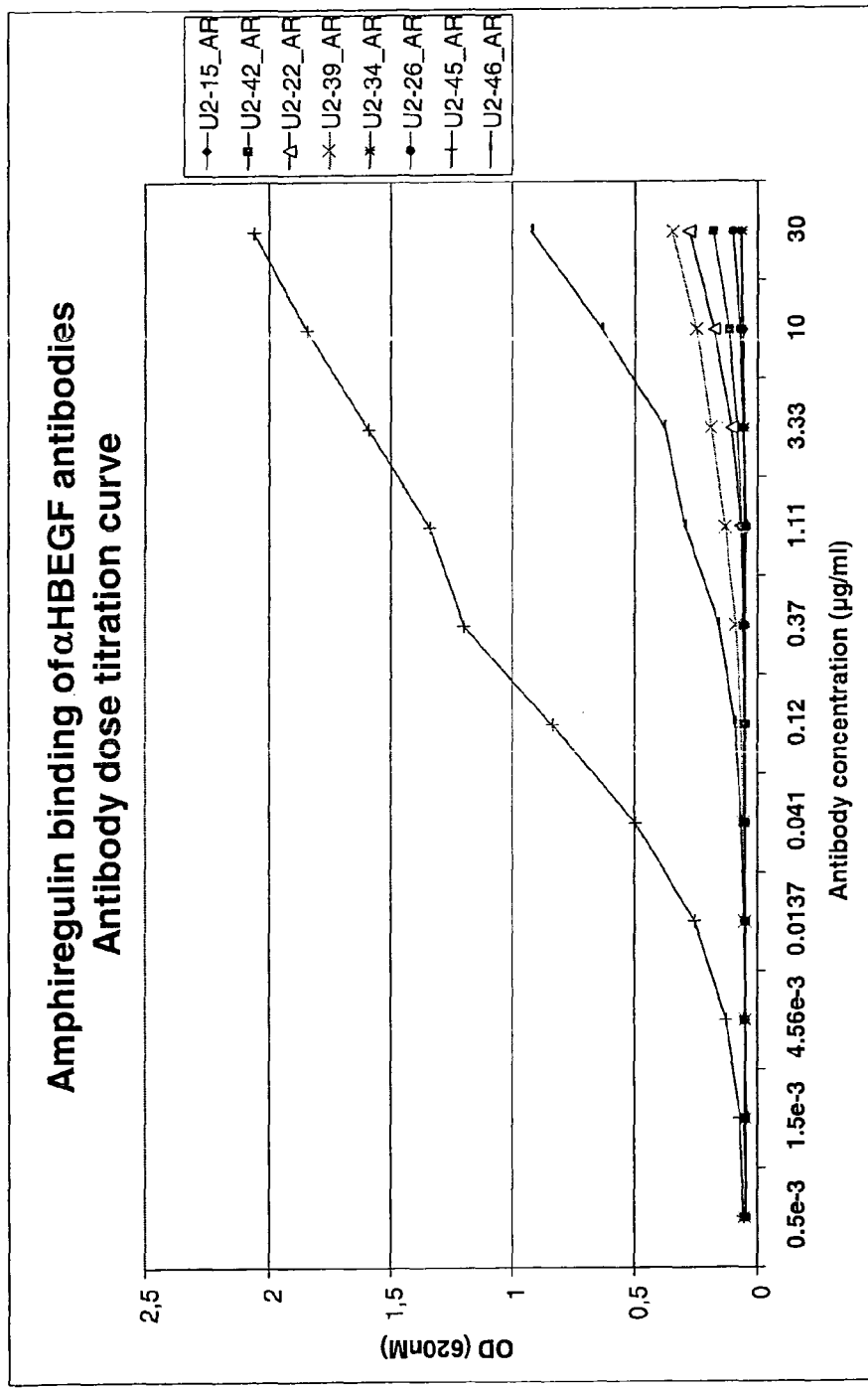
FIG. 30A shows that monoclonal antibody preparations cross-react with HB-EGF from cynomolgus monkeys as assessed by flow cytometry (FACS) using HEK-293 cells transfected with a DNA vector expressing cynomolgus HB- EGF. As shown, very low X-mean values (1-2) are observed for HEK-293 control cells that were transfected with an empty vector control. In contrast, X-mean values of 250 or more were observed when HEK-293 cells were transfected with an expression cassette encoding cynomolgus monkey HB-EGF.
FIG. 30B shows that monoclonal antibody U2-45 preparation cross-reacts with HB-EGF from mouse as assessed by flow cytometry (FACS) using HEK-293 cells transfected with a DNA vector expressing mouse HB-EGF. X-mean values of 33.7 were observed when HEK-293 cells were transfected with an expression cassette encoding mouse HB-EGF.
FIG. 30C shows the degree of cross-reactivity of HB-EGF antibodies with amphiregulin.

As shown by the FACS analysis in FIG. 30, HB-EGF is expressed on HUVECs. The results of the cellular proliferation tests are provided in FIGS. 32A-B. As shown in FIG. 32A, HB-EGF stimulates HUVEC cellular proliferation by about 38%. However, upon addition of anti-HB-EGF antibody preparations U2-42, U2-39 or U2-45, such stimulation of cellular proliferation is inhibited by about 8% to 14% (FIG. 31B). In this assay, the U2-39 anti-HB-EGF antibody preparation provided the highest level of inhibition.

The results of the tube formation tests are provided in FIGS. 33A-M. Control assays, without anti-HB-EGF antibodies shown in FIGS. 34A-C, show that HUVEC cells join to form circular structures or "tubes." However, upon addition of anti-HB-EGF antibody preparations U2-42, U2-39 or U2-45, such tube formation is inhibited. A summary of the number of tubes observed is provided in FIG. 33M. As shown in FIG. 33M, the U2-42 anti-HB-EGF antibody preparation provided the highest acceleration of tube regression, followed by the U2-39 anti-HB-EGF antibody preparation.

Q. Example 17

Anti-HB-EGF Antibodies Inhibit HB-EGF-Stimulated and Basal Colony Formation

Soft agar assays were conducted in order to investigate the ability of the antibodies provided herein to inhibit anchorage independent cell growth. The soft agar colony formation assay is a standard in vitro assay to test for transformed cells, as only such transformed cells can grow in soft agar.

To perform this assay, OVCAR-8, BM-1640 and NCI-H226 cells were incubated with 10 ng/ml HB-EGF and with anti-HB-EGF antibodies or IgG2 (SIGMA) as negative control, at 20 µg/ml in IMDM medium (Gibco) and resuspended in 0.2% Difco noble agar. The cell suspension was plated on a 0.4% agar-underlayer in quadruplicate in a 96-well plate and overlaid with IMDM medium. Colonies were allowed to form for approximately 14 days and were then stained with 40 µl MTT (Sigma, 1 mg/ml in PBS) for 4 hours. Stimulation of HB-EGF and inhibitory effects of anti-HB-EGF antibodies were quantified by HTSBonit (LemnaTec) colony formation software.

In another assay, 750 or 1000 cells (depending on SkOV-3 clone 71 or 74, FIGS. 34D and E) were preincubated with anti-HB-EGF antibodies or IgG2 (SIGMA) as negative control, at 20 µg/ml in IMDM medium (Gibco) for 30 min at 37° C. and resuspended in 0.4% Difco noble agar (or 0.2% for clone 74). The cell suspension was plated on a 0.75% agar-underlayer (0.4% for clone 74) in quadruplicate in a 96-well plate and overlaid with IMDM medium. In a similar assay, 2000 BxPC-3 cells (FIG. 34F) were preincubated with 20 µg/ml anti-HB-EGF antibodies or 20 µg/ml IgG2 (SIGMA) as negative control, in IMDM medium (Gibco) containing 20% FCS for 30 min at 37° C. Cells were resuspended in 0.4% Difco noble agar and the cell suspension was plated on a 0.75% agar-underlayer in quadruplicate in a 96-well plate. The wells were overlaid with IMDM medium. Both layers contained 20% FCS.

Colonies were allowed to form for approximately 14 days and were then stained with 40 µl MTT (Sigma, 1 mg/ml in PBS) for 4 hours. Results are shown in FIGS. 34A-F, which illustrate that HB-EGF stimulated colony formation (FIG. 34A-C) and basal colony formation (FIGS. 34D-F) is significantly reduced by the anti-HB-EGF antibodies. As shown, for example, in FIG. 34A, HB-EGF stimulated OVCAR-8 cells to form a significantly larger mean colony size than control OVCER-8 cells cultured without HB-EGF. However, when OVCAR-8 cells were cultured with anti-HB-EGF U2-39 antibodies in the presence of HB-EGF, mean colony size was reduced to a size similar to that observed for control cells without HB-EGF treatment (FIG. 34A). Similar results were observed for BM1604 cells (derived from prostate cancer tissue) (see, FIG. 34B). Anti-HB-EGF U2-45 and U2-42 antibodies also inhibited BM1604 colony formation.

Anti-HB-EGF antibodies also inhibit HB-EGF-stimulated colony formation of NCI-H226 lung carcinoma cells (FIG. 34C). As shown in FIG. 36C, when NCI-H226 cells were cultured with anti-HB-EGF U2-39 antibodies in the presence of HB-EGF, mean colony size was reduced to a size similar to that observed for control cells without HB-EGF treatment.

The numbers of colonies, as well as the colony size, are reduced by the treatment with the present anti-HB-EGF antibodies (FIGS. 34D-F). Thus, FIG. 34D illustrates that anti-HB-EGF antibodies reduce the number of basal colonies formed by SkOV-3 HB-EGF clone 71 cells (derived from SkOV-3 ovarian cancer cells stably transfected with a proHB-EGF expression construct). As shown, control SkOV-3 cells overexpressing HB-EGF formed large numbers of colonies. However, when SkOV-3 HB-EGF cl. 71 cells were cultured with either anti-HB-EGF U2-42 or U2-39 antibodies in the presence of HB-EGF, the number of colonies was dramatically reduced. Similarly, anti-HB-EGF antibodies inhibit colony formation of SkOV-3 (clone 74) cells, derived from ovarian cancer tissue, and BxPC3 cells, derived from pancreatic adenocarcinoma tissue (FIGS. 34E-F).

These data indicate that colony formation and tumors by a large variety of cancer cell types can be inhibited by the present anti-HB-EGF antibodies, including the U2-42, U2-39 and U2-45 antibody preparations provided herein.

R. Example 18

Anti HB-EGF Antibodies Inhibit Tumor Growth In Vivo

FIG. 37 illustrates the mean volume of pancreatic BxPC3 tumors formed in xenograft experiments with SCID mice. As shown, established tumor growth was significantly inhibited in the presence of antibody preparations U2-42 and/or U2-39 when compared to the vehicle control. In FIG. 38A it is shown that anti-HB-EGF antibodies U2-42, U2-39 and U2-45 inhibit the established growth of EFO-27 HB-EGF clone 58 cells in vivo. The effect of tumor growth inhibition could be shown to be dose-dependent, with 25 mg/kg as a highly effective treatment while lower doses such as 1 or 5 mg/kg were less efficient (FIG. 38B).

S. Example 19

Figure 35:
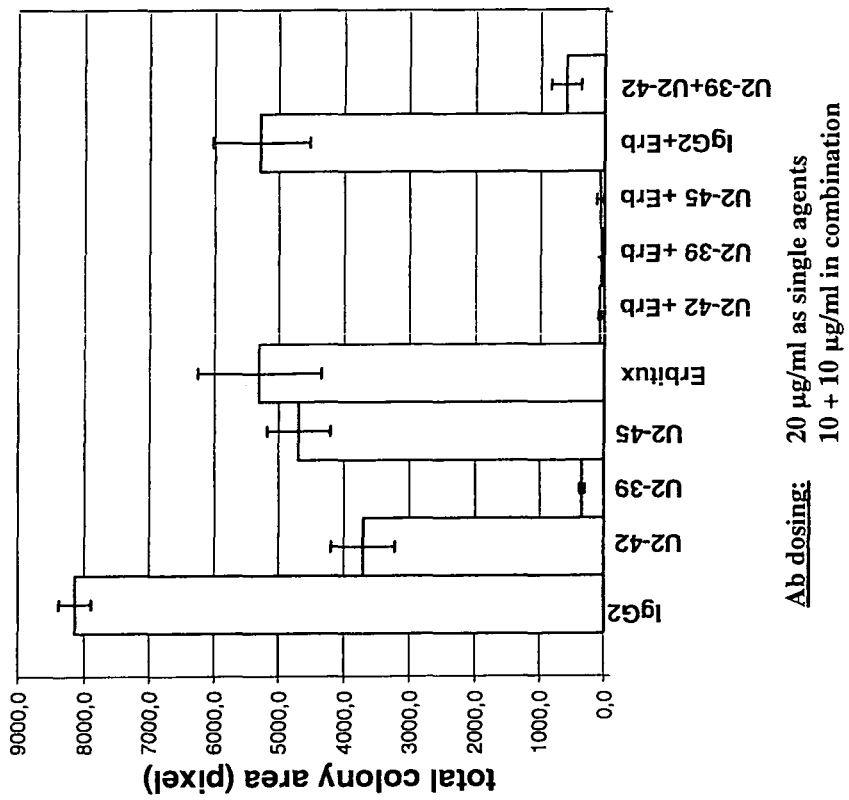
FIG. 35 illustrates that anti-HB-EGF antibodies inhibit basal colony formation of EFO-27 HB-EGF clone 58 ovarian cancer cells overexpressing HB-EGF grown in soft agar. As shown, control cells formed large numbers of colonies. However, when EFO-27 HB-EGF cl. 58 cells were cultured with either anti-HB-EGF U2-42, U2-39 or U2-45 antibodies the number of colonies was dramatically reduced. Moreover, combination therapy of anti-HB-EGF antibodies with the anti-EGFR antibody Erbitux completely inhibited the colony formation.

Anti-HB-EGF Antibodies in Combination Therapy with the Antiegfr Antibody Erbitux FIG. 35 shows that single agent inhibition of EFO-27 HB-EGF cl. 58 cells with anti-HB-EGF antibodies is moderate to strong. However, in a dose-controlled combination of anti-HB-EGF and anti-EGFR antibodies the inhibition of colony formation is extremely effective. Moreover, in vivo xenograft growth is strongly inhibited by the anti-HB-EGF and anti-EGFR antibody combination leading to a complete regression of ovarian cancer tumor growth (FIG. 38C).

T. Example 20

HB-EGF Expression on a Variety of Cancer Cell Types

HB-EGF expression on human cancer cell-lines was determined by FACS analysis. To perform this analysis $2 \times 10^5$ cells were harvested with 10 mM EDTA in PBS, resuspended in FACS-buffer (PBS, 3% FCS, 0.4% azide) and transferred to a 96-well round bottom plate. After centrifugation for 3 min at 1000 rpm to remove supernatant, the cells were resuspended in anti-HB-EGF antibody dilution (100 µl/well) and incubated at 4° C. for 45 min. The cells were washed twice with FACS buffer and resuspended with secondary antibody (100 μl/well) donkey-anti-human-PE (Jackson) diluted 1:100 in FACS buffer. The cell suspensions were incubated at 4° C. in the dark for 30 minutes, washed twice with FACS buffer and analyzed (FACS, Beckman Coulter).

The results of these assays are shown in TABLE 6, below.

TABLE 6

HB-EGF Expression in Cancer Cells

| Cell line | Tissue | Expression Level |
|---|---|---|
| MDA-MB231 | Breast | ++ |
| NCI-ADR | Breast | +++ |
| ZR75-1 | Breast | −/+ |
| MKN-1 | Gastric | + |
| MKN-28 | Gastric | +++ |
| PPC1 | Prostate | ++ |
| PC3 | Prostate | ++ |
| HT144 | Melanoma | −/+ |
| MelGerlach | Melanoma | +++ |
| IGROV-1 | Ovarian | + |
| ES2 | Ovarian | ++ |
| SkOV-3 | Ovarian | + |
| SkOV-8 | Ovarian | + |
| TOV21G | Ovarian | ++ |
| OVCAR-8 | Ovarian | +++ |
| Calu-6 | Lung | + |
| NCI-H460 | Lung | ++ |
| MS-751 | Cervix | ++ |
| SIHA | Cervix | + |
| HelaS3 | Cervix | + |
| U266 | Myeloma | − |
| SCABER | Bladder | ++ |
| HCT-116 | Colon | ++ |
| HCT-15 | Colon | + |
| SW620 | Colon | ++ |

U. Example 21

Anti-HB-EGF Antibodies for the Detection of HB-EGF in Tissue and Body Fluids by Immunohistochemistry and Elisa Anti-HB-EGF antibodies U2-42 and U2-39 were tested for their ability to stain HB-EGF expressed in human fixed samples. As shown in FIG. 39A both antibodies show a prominent membrane and cytoplasmic staining of human kidney tubular cells while the control does not show any staining. In addition to the immunohistochemical detection of HB-EGF in patient tissue samples HB-EGF is released as a growth factor into various body fluids. Based on human anti-HB-EGF antibodies as coating reagents an ELISA was established which detects HB-EGF in liquid samples down to levels below 40 pg/ml (FIG. 39B).

V. Example 22

Canonical Classes of Antibodies

The genes encoding top antibodies were sequenced as described in the last Example. This sequence data was used to assign the antibodies to canonical classes.

Chothia et al. have described antibody structure in terms of "canonical classes" for the hypervariable regions of each immunoglobulin chain (Chothia, et al., 1987, J. Mol. Biol., 196(4): 901-17). The atomic structures of the Fab and VL fragments of a variety of immunoglobulins were analyzed to determine the relationship between their amino acid sequences and the three-dimensional structures of their antigen binding sites. Chothia et al. found that there were relatively few residues that, through their packing, hydrogen bonding or the ability to assume unusual phi, psi or omega conformations, were primarily responsible for the main-chain conformations of the hypervariable regions. These residues were found to occur at sites within the hypervariable regions and in the conserved α-sheet framework. By examining sequences of immunoglobulins having unknown structure, Chothia, et al. show that many immunoglobulins have hypervariable regions that are similar in size to one of the known structures and additionally contained identical residues at the sites responsible for the observed conformation.

Their discovery indicated that these hypervariable regions have conformations close to those in the known structures. For five of the hypervariable regions, the repertoire of conformations appeared to be limited to a relatively small number of discrete structural classes. These commonly occurring main-chain conformations of the hypervariable regions were termed "canonical structures." Further work by Chothia, et al., 1989; Nature 342:877-83) and others (Martin et al., 1996; J. Mol. Biol. 263:800-15) confirmed that there is a small repertoire of main-chain conformations for at least five of the six hypervariable regions of antibodies.

The complementarity determining regions (CDRs) of each antibody preparation were analyzed to determine their canonical class. As is known, canonical classes have only been assigned for CDR1 and CDR2 of the antibody heavy chain, along with CDR1, CDR2 and CDR3 of the antibody light chain. The TABLES below summarize the results of the analysis. The Canonical Class data is in the form of HCDR1-HCDR2-LCDR1-LCDR2-LCDR3 (H1-H2-L1-L2-L3), wherein "HCDR" refers to the heavy chain CDR and "LCDR" refers to the light chain CDR. Thus, for example, a canonical class of 1-3-2-1-1 refers to an antibody that has a HCDR1 that falls into canonical class 1, a HCDR2 that falls into canonical class 3, a LCDR1 that falls into canonical class 2, a LCDR2 that falls into canonical class 1, and a LCDR3 that falls into canonical class 1.

Assignments were made to a particular canonical class where the amino acids in the antibody match with the amino acids defined for each canonical class. The amino acids defined for each canonical class can be found, for example, in the articles by Chothia, et al. referred to above. TABLE 7 and TABLE 8 report the canonical class assignments for each of the HB-EGF antibodies. Where there was no matching canonical class, the canonical class assignment is marked with a letter s and a number, such as "s18", meaning the CDR is of size 18.

TABLE 7

| Antibody (sorted) | H1-H2-L1-L2-L3 | H3length |
|---|---|---|
| U2-18.1 | 3-1-2-1-1 | 17 |
| U2-13.1 | 1-3-4-1-1 | 14 |
| U2-19.1 | 3-1-3-1-1 | 13 |
| U2-38.1 | 3-1-2-1-1 | 23 |
| U2-21.1 | 3-1-3-1-s9 | 8 |
| U2-15.1 | 1-3-4-1-1 | 14 |
| U2-16.1 | 1-2-8-1-1 | 11 |
| U2-30.1 | 1-2-3-1-1 | 13 |
| U2-42.1 | 1-3-2-1-s9 | 8 |
| U2-36.1 | 3-s18-2-1-s10 | 13 |
| U2-22.1 | 1-3-3-1-1 | 11 |
| U2-56.1 | 3-1-2-1-1 | 8 |
| U2-24.1 | 3-s16-3-1-s9 | 12 |
| U2-24.2.1 | 3-s16-3-1-s9 | 12 |

TABLE 7-continued

| Antibody (sorted) | H1-H2-L1-L2-L3 | H3length |
|---|---|---|
| U2-14.1 | 1-3-4-1-1 | 14 |
| U2-1.1 | 1-3-4-1-1 | 5 |
| U2-32.1 | 1-1-3-1-1 | 15 |
| U2-40.1 | 1-3-2-1-3 | 8 |
| U2-5.1 | 1-3-4-1-1 | 6 |
| U2-8.1 | 3-1-4-1-1 | 17 |
| U2-39.1 | 1-3-2-1-1 | 6 |
| U2-3.1 | 3-1-4-1-1 | 16 |
| U2-43.1 | 1-1-2-1-1 | 12 |
| U2-34.1 | 1-3-2-1-1 | 16 |
| U2-26.1 | 3-1-3-1-s9 | 9 |
| U2-41.1 | 1-3-2-1-1 | 12 |
| U2-45.1 | 1-3-2-1-1 | 19 |
| U2-54.1 | 3-1-2-1-1 | 15 |
| U2-57.1 | 3-1-2-1-1 | 8 |
| U2-12.1 | 1-3-2-1-s9 | 9 |
| U2-46.1 | 1-3-2-1-1 | 16 |
| U2-48.2 | 1-1-2-1-1 | 12 |
| U2-6.1.1 | 1-3-4-1-1 | 11 |
| U2-6.1.2 | 1-3-2-1-1 | 16 |
| U2-58.1 | 3-s16-2-1-1 | 8 |
| U2-51.1 | 1-3-2-1-1 | 16 |
| U2-65.2 | 3-1-2-1-1 | 8 |
| U2-53.1 | 1-1-2-1-1 | 12 |
| U2-61.1 | 1-3-2-1-1 | 9 |
| U2-28.1 | 3-1-3-1-s9 | 12 |

TABLE 8

| Antibody | H1-H2-L1-L2-L3 (sorted) | H3 Length |
|---|---|---|
| U2-43.1 | 1-1-2-1-1 | 12 |
| U2-48.2 | 1-1-2-1-1 | 12 |
| U2-53.1 | 1-1-2-1-1 | 12 |
| U2-32.1 | 1-1-3-1-1 | 15 |
| U2-30.1 | 1-2-3-1-1 | 13 |
| U2-16.1 | 1-2-8-1-1 | 11 |
| U2-39.1 | 1-3-2-1-1 | 6 |
| U2-61.1 | 1-3-2-1-1 | 9 |
| U2-41.1 | 1-3-2-1-1 | 12 |
| U2-34.1 | 1-3-2-1-1 | 16 |
| U2-46.1 | 1-3-2-1-1 | 16 |
| U2-6.1.2 | 1-3-2-1-1 | 16 |
| U2-51.1 | 1-3-2-1-1 | 16 |
| U2-45.1 | 1-3-2-1-1 | 19 |
| U2-40.1 | 1-3-2-1-3 | 8 |
| U2-42.1 | 1-3-2-1-s9 | 8 |
| U2-12.1 | 1-3-2-1-s9 | 9 |
| U2-22.1 | 1-3-3-1-1 | 11 |
| U2-1.1 | 1-3-4-1-1 | 5 |
| U2-5.1 | 1-3-4-1-1 | 6 |
| U2-6.1.1 | 1-3-4-1-1 | 11 |
| U2-13.1 | 1-3-4-1-1 | 14 |
| U2-15.1 | 1-3-4-1-1 | 14 |
| U2-14.1 | 1-3-4-1-1 | 14 |
| U2-56.1 | 3-1-2-1-1 | 8 |
| U2-57.1 | 3-1-2-1-1 | 8 |
| U2-65.2 | 3-1-2-1-1 | 8 |
| U2-54.1 | 3-1-2-1-1 | 15 |
| U2-18.1 | 3-1-2-1-1 | 17 |
| U2-19.1 | 3-1-3-1-1 | 13 |
| U2-21.1 | 3-1-3-1-s9 | 8 |
| U2-26.1 | 3-1-3-1-s9 | 9 |
| U2-28.1 | 3-1-3-1-s9 | 12 |
| U2-3.1 | 3-1-4-1-1 | 16 |
| U2-8.1 | 3-1-4-1-1 | 17 |
| U2-58.1 | 3-s16-2-1-1 | 8 |
| U2-24.1 | 3-s16-3-1-s9 | 12 |
| U2-24.2.1 | 3-s16-3-1-s9 | 12 |
| U2-36.1 | 3-s18-2-1-s10 | 13 |
| U2-38.1 | 3-1-2-1-1 | 23 |

TABLE 9 is an analysis of the number of antibodies per class. The number of antibodies having the particular canonical class designated in the left column is shown in the right column.

The most commonly seen structure is 1-3-2-1-1. Eight out of a total of 40 mAbs had this combination.

TABLE 9

Number of Anti-HB-EGF Antibodies in Each Canonical Class Combination

| H1-H2-L1-L2-L3 | Count |
|---|---|
| 1-1-2-1-1 | 3 |
| 1-1-3-1-1 | 1 |
| 1-2-3-1-1 | 1 |
| 1-2-8-1-1 | 1 |
| 1-3-2-1-1 | 8 |
| 1-3-2-1-3 | 1 |
| 1-3-2-1-s9 | 2 |
| 1-3-3-1-1 | 1 |
| 1-3-4-1-1 | 6 |
| 3-1-2-1-1 | 5 |
| 3-1-3-1-1 | 1 |
| 3-1-3-1-s9 | 3 |
| 3-1-4-1-1 | 2 |
| 3-s16-2-1-1 | 1 |
| 3-s16-3-1-s9 | 2 |
| 3-s18-2-1-s10 | 1 |
| 3-1-2-1-1 | 1 |

W. Example 23

Epitope Mapping of Anti HB-EGF Antibodies

This Example describes the mapping of epitopes recognized by antibody preparations.

Antibodies tested: Five XenoMouse derived human monoclonal antibody preparations capable of neutralizing the activity of HB-EGF were analyzed: U2-39; U2-42; U2-45; U2-26 and U2-19. Four of these monoclonal antibody preparations were shown to be specific for human HB-EGF while antibody preparation U2-45 exhibited some cross-reactivity with mouse HB-EGF and human Amphiregulin. All of these neutralizing antibody preparations map to MCAB Bins 7 & 8 (see, below).

1. Epitope Mapping

The human HB-EGF cDNA was isolated from HeLa mRNA by PCR amplification and the mature HB-EGF sequence was cloned into a pSecTAg vector as a myc-His fusion protein, using the Ig kappa signal peptide sequence. The mature HB-EGF polypeptide was expressed in 293T cells, with secretion into the media.

The diphtheria toxin binding site of HB-EGF was mutated as well as the EGF receptor binding site by site-directed mutagenesis.

The short form of HB-EGF (Loukianov et al; Gene 195: 81-86), missing the third disulphide bond of the EGF-like domain, was also cloned.

The EGF-like domain of HB-EGF having SEQ ID NO:1082 (DPCLRKYKD FCIHGECKYVKELRAP-SCICHPGYHGERCHGLSLP) was cloned into pSecTag and expressed and secreted as a Myc-His fusion protein.

2. Results

All of the U2-39; U2-42; U2-45; U2-26 and U2-19 antibody preparations recognize a discontinuous epitope. None of the antibodies recognize the Short form of the HB-EGF.

The binding site for all five antibody preparations is within the EGF-like domain, which included residues 44-86 of the mature protein having the following sequence: DPCL-RKYKDFCIHGECKYVKELRAPSCICHPGYHGERCHGLSLP (SEQ ID NO:1082). The third disulfide bond in the EGF-like domain is required for binding of all of the U2-39; U2-42; U2-45; U2-26 and U2-19 antibody preparations.

3. Structure-Function Analysis of Antibody Binding Site by Site Directed Mutagenesis Twelve independent mutations were created in HB-EGF by replacing one to four residues within the EGF-like domain of human pro-HB-EGF with the corresponding amino acid residue normally found in the mouse pro-HB-EGF.

Given that many of the present antibody preparations were species selective, site-directed mutagenesis for the purpose of identifying HB-EGF epitopes was done at known difference between the human HB-EGF protein and related proteins from different species. In particular, the amino acid differences between human and mouse HB-EGF are as follows: K122R; V124L; K155Q; I133K; and H135L.

A complete list of HB-EGF mutant polypeptide sequences for epitope mapping is provided in TABLE 10. Mutant HB-EGF nucleic acids encoding the desired mutant protein were transiently expressed in 293T cells, and monoclonal antibody binding was measured by ELISA.

Thus, HB-EGF mutant polypeptides were made with these mutations and such mutant polypeptides were tested to ascertain if the present antibody preparations still bound to the HB-EGF mutant polypeptide. If not, then the mutated amino acid was likely important for antibody binding, and hence formed an important part of an epitope.

TABLE 11 summarizes the binding results obtained, where "Yes" indicates that binding took place despite the indicated mutation, "No" indicates that binding was substantially eliminated by the indicated mutation, and "Reduced" indicates that reduced binding occurred when the mutation was present.

TABLE 10

| Wild type | LGKKRDPCLRKYKDFCIHGE-<br>CKYVKELRAPSCICHPGYHGERCHGLSLP | SEQ ID NO: |
|---|---|---|
| F115Y | --------------Y---------------------------------- | 1083 |
| L127F | --------------------------F---------------------- | 1084 |
| E141H | ----------------------------------------H-------- | 1085 |
| K122R;<br>V124L;<br>K125Q | ---------------------R-LQ------------------------ | 1086 |
| F115Y;<br>K122R;<br>V124L;<br>K125Q | --------------Y------R-LQ------------------------ | 1087 |
| K122R;<br>V124L;<br>K125Q;<br>E141H | ---------------------R-LQ---------------H-------- | 1088 |
| I133K;<br>H135L | --------------------------------K-L-------------- | 1089 |
| F115Y;<br>I133K;<br>H135L | --------------Y-----------------K-L-------------- | 1090 |
| L127F;<br>I133K;<br>H135L | --------------------------F-----K-L-------------- | 1091 |
| L148T | -----------------------------------------------T- | 1092 |
| E141H;<br>L148T | ----------------------------------------H------T- | 1093 |
| 117-120<br>IHGE<br>changed to<br>LHDGV | ----------------LHDGV---------------------------- | 1094 |

TABLE 11

| | Binding Results | | | | | |
|---|---|---|---|---|---|---|
| | Construct/Mab | U2-42.3 | U2-39.1 | U2-19.3 | U2-26.1 | U2-45 |
| 1 | Human proHB-EGF (WT) | Yes | Yes | Yes | Yes | Yes |
| 2 | F115Y | No | No | Yes | Yes | Reduced |
| 3 | L127F | Yes | No | Yes | Yes | Yes |
| 4 | E141H | No | Yes | Yes | Yes | Yes |

TABLE 11-continued

| Construct/Mab | U2-42.3 | U2-39.1 | U2-19.3 | U2-26.1 | U2-45 |
|---|---|---|---|---|---|
| 5 K122R, V124L, K125Q | Yes | Yes | Yes | Yes | Yes |
| 6 F115Y, K122R, V124L, K125Q | No | No | Yes | Yes | Reduced |
| 7 K122R, V124L, K125Q, E141H | No | Yes | Yes | Yes | Yes |
| 8 I133K, H135L | Yes | Yes | No | No | Yes |
| 9 F115Y, I133K, H135L | No | No | No | No | Reduced |
| 10 L127F, I133K, H135L, | Yes | No | No | No | Yes |
| 11 S147T | Yes | Yes | Yes | Yes | Yes |
| 12 E141H, S147T | No | Yes | Yes | Yes | Yes |
| 13 IHGE (117-120) to LHDGV | Yes | Yes | No | No | No |
| Critical residues | F115 & E141 | F115 & L127 | I133 or H135 | I133 or H135 | F115? |

Binding Results

These binding studies indicate that the U2-42 and U2-39 antibody preparations recognize the diphtheria toxin binding domain and the F115, L127 and E141 residues are important for diphtheria toxin binding.

Furthermore, when the F115Y or E141H mutations are present in HB-EGF, binding is substantially eliminated for the U2-42 antibody preparations. Thus, Phe-115 and Glu-141 are important for U2-42 antibody binding. The U2-45 antibody preparation also appears to require Phe-115 because binding by this antibody preparation is reduced when Phe-115 is mutated.

The U2-39 antibody preparation requires Phe-115 and Leu-127 for binding HB-EGF because mutation of either of those residues substantially eliminates antibody binding.

The U2-19, U2-26 and U2-45 antibody preparations bind the conserved region between residues 117-120 (IHGE). As shown in TABLE 11, antibody preparations U2-19 and U2-26 also recognize an epitope at Ile-133 and/or His-135, because at least one of these residues is critical for their binding.

Based on their binding properties, of the antibodies were placed in the relationship "bins" listed in TABLE 12.

Binning is a method to group antibodies based on their competition for binding to the antigen (see, Jia et al., 2004, *J. Immunol. Methods* 288:91-98).

The assignment of bins depended on how different the observed binding patterns for all the antibodies tested are. Therefore, bins do not always correlate with epitopes determined by other means and can be used to only roughly define epitopes.

TABLE 12

Antibody Relationship Bins

| Bin#1 | Bin#2 | Bin#3 | Bin#4 | Bin#5 | Bin#6 | Bin#7 | Bin#8 |
|---|---|---|---|---|---|---|---|
| U2-24.2 | U2-1.3 | U2-15.3 | U2-13.3 | U2-16.3 | U2-18.3 | U2-19.2 | U2-3.2 |
| U2-32.3 | | U2-30.2 | U2-14.3 | | U2-38.1 | U2-21.3 | |
| U2-5.3 | | | U2-2.1 | | 1.19.2 | U2-34.1 | |
| U2-17.1 | | | U2-57.1 | | U2-36.3 | U2-26.2 | |
| U2-56.3 | | | U2-58.3 | | U2-40.3 | U2-41.3 | |
| | | | U2-61.1 | | U2-8.3 | U2-45.3 | |
| | | | | | U2-22.3 | U2-46.3 | |
| | | | | | U2-39.1 | U2-48.2.1 | |
| | | | | | U2-54.2 | U2-6.1 | |
| | | | | | | U2-51.2 | |
| | | | | | | U2-53.3 | |
| | | | | | | U2-28.2 | |

In general the epitope mapping of U2-45 antibody preparation indicates that the Bin 7 antibody preparations cross-react with mouse HB-EGF and human Amphiregulin.

Mutations of F115 to Ala or Tyr affect the binding affinity of U2-45 antibodies. However, U2-45 antibody binding was not affected by mutations of I133 and H135, which did affect some other Bin 7 antibody preparations. When the IHGE human HB-EGF sequence was changed to LHDGV, which is present in mouse HB-EGF and human Aphiregulin, all Bin7 antibody preparations failed to bind. Therefore, the IHGE residues (117-120) likely form the epitope for bin 7 antibody preparations.

Further site-directed mutagenesis studies involving binding of HB-EGF mutants to EGFR, indicate that residues including Asp-106 and Pro-107 are both necessary for optimal binding of HB-EGF to the EGF receptor. Moreover, Leu-148, which is necessary for HB-EGF binding to the EGF receptor, did not appear to be involved in the binding of any of the anti-HB-EGF antibody preparations.

HH. Example 24

Sequences of Key Elements of Anti HB-EGF Antibodies

This Example provides the sequences of antibody preparations in FIGS. 1-21.

Example 25A

Scratch Assay—Inhibition of HB-EGF-Induced Migration of CLS354 Epithelial Squamous Carcinoma Cells (Mouth)

Scratch experiments were performed in order to investigate whether the antibodies of the invention block cell migration that would otherwise be directly induced by HB-EGF.

$1 \times 10^6$ CLS354 cells were seeded in medium (RPMI medium with 10% FCS) in 1 ml on a 12-well plate and serum starved (medium with 0.5% FCS) over night. After cells have reached a confluent layer, a scratch was performed in the middle of the well using a sterile plastic tip. Cells were washed with PBS and scratched CLS354 cells were treated alone or containing 20 ng/ml HB-EGF in the presence or absence of 10 µg/ml U2-39, Erbitux or human IgG. The experiment was stopped after 12 hour incubation at 37° C. Medium was withdrawn, cells were washed with PBS and fixed with 100% ice-cold methanol at −20° C., stained with crystal-violet, washed and dried over night. Photographs were taken for documentation.

FIG. 40A shows that HB-EGF treatment stimulates the closure of the scratch and that the antibody of invention, U2-39, inhibits HB-EGF-mediated migration of CLS354 epithelial squamous carcinoma cells into the scratch.

Example 25B

Transmigration Assay—Inhibition of HB-EGF-Induced Migration of Detroit 562 Epithelial Carcinoma Cells (Pharynx)

Transmigration experiments were performed in order to investigate whether the antibodies of the invention block cell migration that would otherwise be directly induced by HB-EGF.

A 500 ml cell suspension of serum-starved human epithelial carcinoma cells (50,000 cells) was placed in the top chamber of fibronectin-coated transwells (BD Falcon, 8 µm pores). Aliquots of 750 ml medium (Minimum essential medium (Eagle) in Earle's BSS with non-essential amino acids, sodium pyruvate (1 mM) and lactalbumin hydrolysate (0.1%), 90%; fetal bovine serum 10%, Pen.-Strept., 0.1% BSA) alone or containing 20 ng/ml HB-EGF (R&D Systems) in the presence or absence of 10 µg/ml human IgG, U2-39 or Erbitux antibodies were placed in the bottom chamber after 30 min pre-incubation at 37° C. After incubation and migration for 6 hours at 37° C., cells were fixed, stained with DAPI and transwells were photographed for evaluation.

The result demonstrates that—HB-EGF antibody U2-39 effectively inhibits HB-EGF-induced Detroit 562 epithelial carcinoma cell migration comparable to the inhibition of HB-EGF-mediated cell migration by Erbitux treatment.

Example 26

Spheroid-Based Cellular Angiogenesis Assay—Inhibition of VEGF-Stimulated Endothelial Cell Sprouting Spheroid-based cellular angiogenesis assays were performed in order to investigate whether the antibodies of the invention are able to inhibit VEGF-induced endothelial cell (EC) sprouting in a collagen matrix. Primary human umbilical vein endothelial cells (HUVEC) were seeded out at 500 cells in a hanging drop on plastic dishes to allow overnight spheroid aggregation. 50 EC spheroids were seeded in 0.9 ml of collagen solution (2 mg/ml) and pipetted into individual wells of a 24 well plate to allow polymerization The antibody of invention U2-39 was directly mixed in the collagen solution before polymerization (different concentrations) and the growth factor VEGF-A (25 ng/ml) was added after 30 min by pipetting 100 µl of a 10-fold concentrated working dilution on top of the polymerized gel. Plates were incubated at 37° C. for 24 hours and fixed by adding 4% paraformaldehyde. Sprouting intensity of EC spheroids was quantitated by an image analysis system determining the cumulative sprout length per spheroid using an inverted microscope and the digital imaging software Analysis 3.2.

Figure 41A:
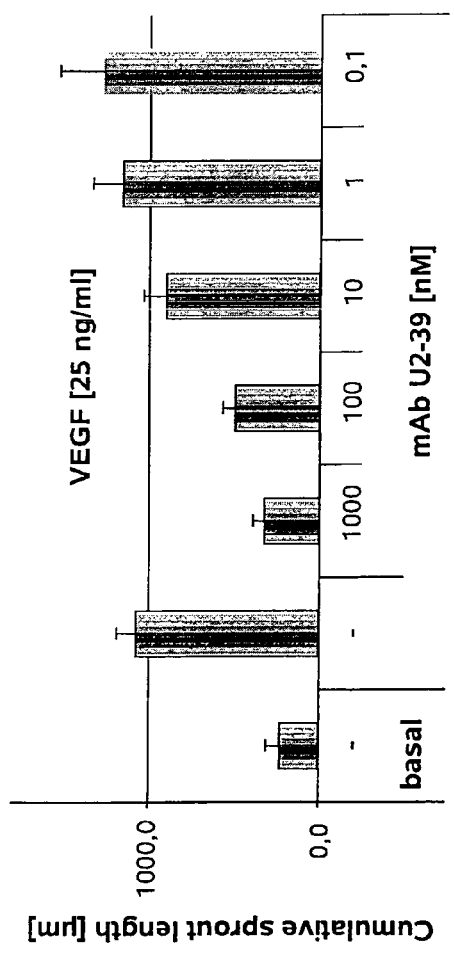
FIG. 41 illustrates a spheroid-based cellular angiogenesis assay indicating the inhibition of VEGF-stimulated endothelial cell sprouting.
Figure 41B:
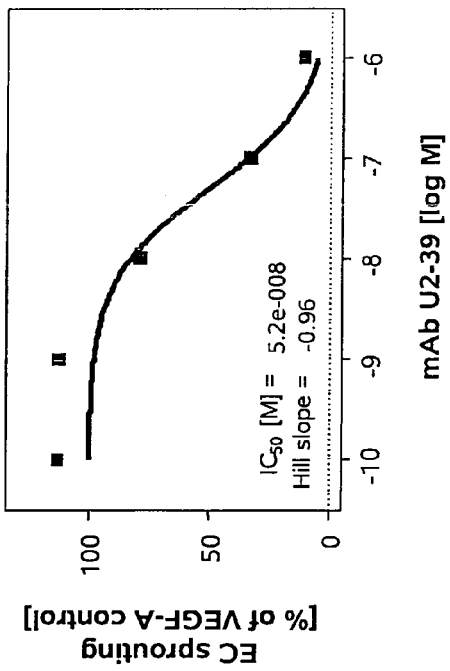

FIG. 41A depicts the mean of the cumulative sprout length of 10 randomly selected spheroids per data point. FIG. 41B shows the relative inhibition of the cumulative sprout length of 10 randomly selected spheroids per data point by U2-39. The fitting of IC50 curves and calculation of IC50 values was performed with GraphPad Prism 4.03.

The results of Example 26 demonstrate that the antibody of the invention U2-39 inhibits VEGF-A-stimulated human umbilical vein endothelial cell sprouting in a dose-dependent manner in the spheroid-based assay using a collagen matrix. HUVEC sprouting was inhibited with an IC50 value of $5.2 \times 10^{-8}$ Molar.

Example 27

Immunohistochemistry (IHC) Analysis of Human Tumor Xenograft Samples—Inhibition of CD31 Staining of Tumor In Vivo In order to investigate the efficacy of the antibody of invention, U2-39, on inhibition of angiogenesis in vivo, human tumor xenografts treated with U2-39 or Erbitux were analyzed by immunohistochemistry analysis.

The human ovarian adenocarcinoma cell line EFO27 was genetically engineered to overexpress HB-EGF and the clone EFO27-C158 was chosen for xenograft studies in SCID mice. $3 \times 10^6$ EFO27-CI58 cells in 100 µl PBS/Matrigel (1:1) were injected subcutaneously into the left flank of 7 week old female C.B-17 SCID mice. Tumor-bearing mice with mean tumor volumes of 250 mm$^3$ were randomized into groups containing 10 animals. Animals were treated intraperitoneally with weekly doses of 25 mg/kg U2-39 or 25 mg/kg Erbitux or control vehicle, PBS, for 3 weeks. After 28 days mice were sacrificed, primary tumor tissues were collected and one half of the tumor was snap-frozen in liquid nitrogen and stored at −80° C.

5 to 8 µm sections of the tumor prepared on glass chamber slides were fixed in 100% acetone for 10 min at 4° C. and dried completely. To block unspecific binding sites slides with fixed tumor sections were treated with Avidin D block (15 minutes), Biotin block (15 minutes) and a 1.25% BSA solution (1 hour). Between each treatment step slides were washed twice with PBS. For immunohistochemical examination of the tumor vasculature the expression of the classical endothelial cell marker CD31, also known as PECAM-1 (Platelet Endothelial Cell Adhesion Molecule-1) was analyzed by treatment of the slides with 2 µg/ml anti-CD31 antibody (diluted in 1.25% BSA solution and incubated for 2 h at room temperature in a humidified chamber). Detection was performed by applying a biotinylated goat ant-rat IgG antibody (30 min at room temperature) and Alexa 546 Streptavidin (15 min in the dark). PBS washing steps were performed between each treatment step. Sections were mounted with VECTASHIELD mounting medium with DAPI in the dark, photographed (fluorescence microscope) for documentation and stored at 4° C.

FIG. 42 demonstrates that human tumor xenografts treated with U2-39 show a reduced endothelial cell marker staining (CD31 staining) compared to Erbitux-treated or control treated tumor xenografts. This result demonstrates the anti-angiogenic efficacy of the antibody of invention in vivo.

Example 28

In Vivo Ovarian Tumor Xenograft Model—Combination Treatment of U2-39 with Cisplatin and Avastin In order to evaluate the anti-tumor efficacy of the antibody of invention administered as a monotherapy or in combination with Cisplatin or Avastin, an ovarian cancer xenograft study was conducted.

The human ovarian adenocarcinoma cell line EFO27 was genetically engineered to overexpress HB-EGF. The clone EFO27-C158 was chosen for xenograft studies in SCID mice.

$3\times10^6$ EFO27-C158 cells in 100 µl PBS/Matrigel (1:1) were injected subcutaneously into the left flank of 7 week old female C.B-17 SCID mice. Tumor-bearing mice with mean tumor volumes between 75 and 175 mm³ were randomized into groups containing 10 animals. Animals were treated intraperitoneally with weekly doses of 25 mg/kg U2-39, 25 mg/kg Avastin or 5 mg/kg Cisplatin or control vehicle, PBS. Combination of U2-39 with Avastin was given at 12.5 mg/kg each and combination of U2-39 with Cisplatin was given at 25 mg/kg antibody with 5 mg/kg Cisplatin. Primary tumor sizes were determined 3 times a week. Following calliper measurement, tumor size was calculated according to the formula W2×L/2 with L=length and W=the perpendicular width of the tumor. Kaplan-Meier log-rank method was used to define time to progression to 500 mm³ (defined as "event" for statistical reasons).

Figure 43A:
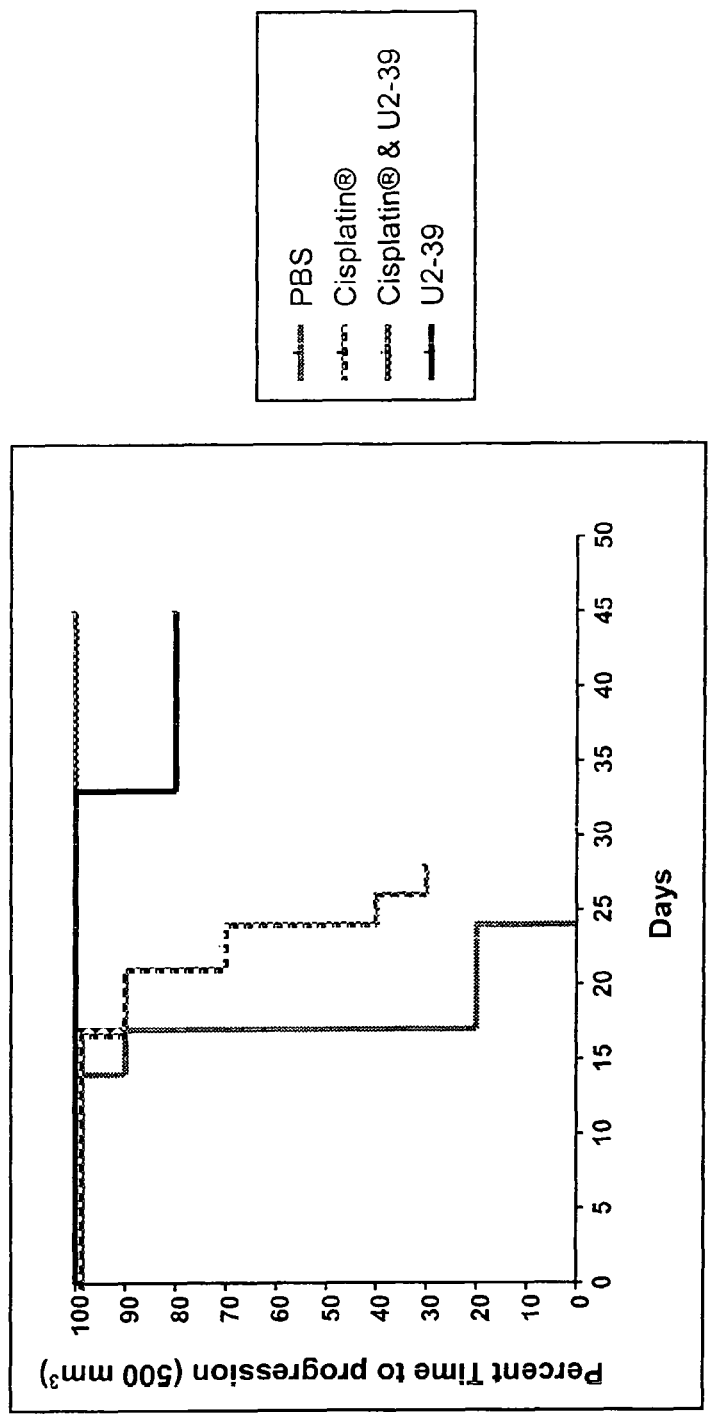
FIG. 43 illustrates in vivo ovarian tumor xenograft model indicating combination treatment of U2-39 with Cisplatin and Avastin.

FIG. 43A demonstrates that combination of U2-39 with Cisplatin led to a stronger tumor reduction during the administration period than treatment with Cisplatin alone. In addition, a combination of U2-39 and Cisplatin delayed the time to progression of the median tumor size to 500 mm³ compared to U2-39 monotherapy.

Figure 43B:
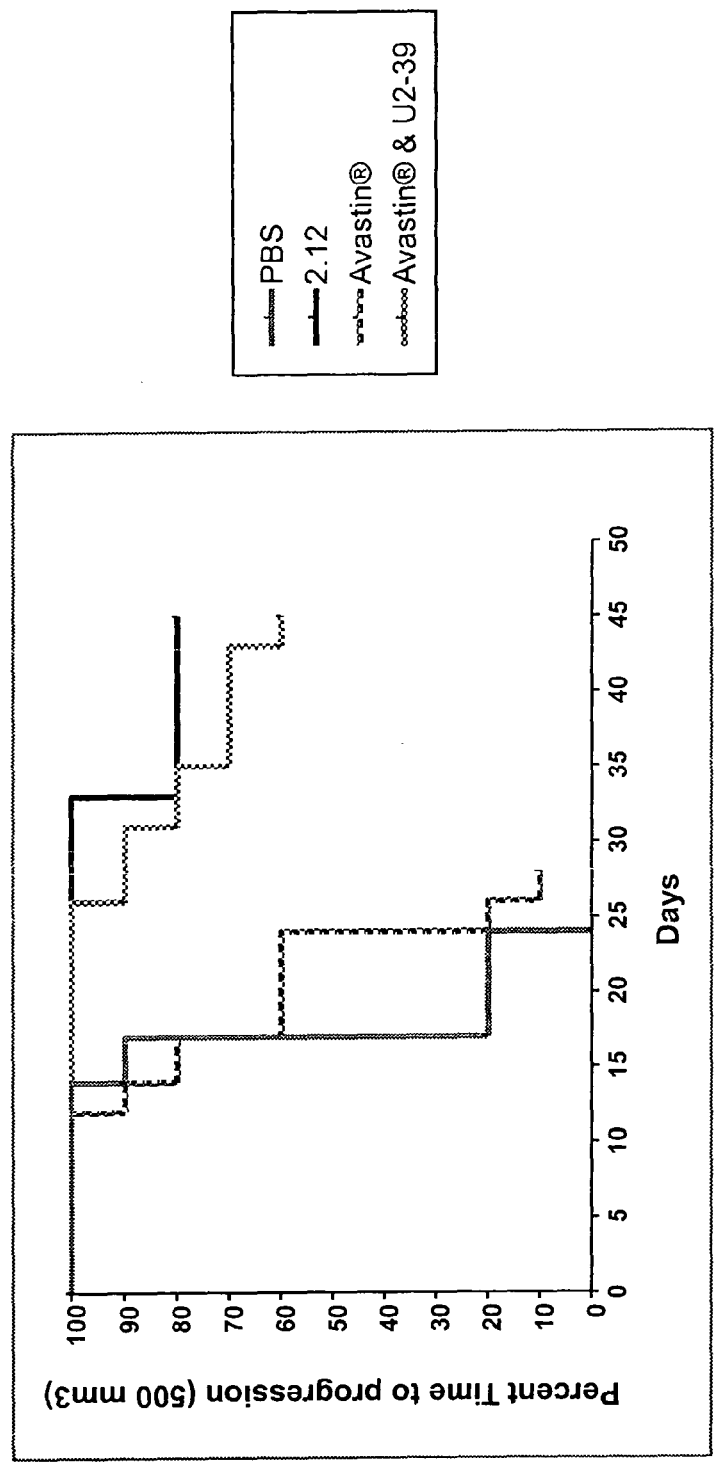

The result in FIG. 43B shows that combination of U2-39 with Avastin significantly delayed the time to progression to 500 mm³ tumor volumes compared to the treatment with Avastin as monotherapy although only half of the single agent dose was administered.

All patents and publications referenced or mentioned herein are indicative of the levels of skill of those skilled in the art to which the invention pertains, and each such referenced patent or publication is hereby incorporated by reference to the same extent as if it had been incorporated by reference in its entirety individually or set forth herein in its entirety. Applicants reserve the right to physically incorporate into this specification any and all materials and information from any such cited patents or publications.

The specific methods and compositions described herein are representative of preferred embodiments and are exemplary and not intended as limitations on the scope of the invention. Other objects, aspects, and embodiments will occur to those skilled in the art upon consideration of this specification, and are encompassed within the spirit of the invention as defined by the scope of the claims. It will be readily apparent to one skilled in the art that varying substitutions and modifications may be made to the invention disclosed herein without departing from the scope and spirit of the invention. The invention illustratively described herein suitably may be practiced in the absence of any element or elements, or limitation or limitations, which is not specifically disclosed herein as essential. The methods and processes illustratively described herein suitably may be practiced in differing orders of steps, and they are not necessarily restricted to the orders of steps indicated herein or in the claims. As used herein and in the appended claims, the singular forms "a," "an," and "the" include plural reference unless the context clearly dictates otherwise. Thus, for example, a reference to "an antibody" includes a plurality (for example, a solution of antibodies or a series of antibody preparations) of such antibodies, and so forth. Under no circumstances may the patent be interpreted to be limited to the specific examples or embodiments or methods specifically disclosed herein. Under no circumstances may the patent be interpreted to be limited by any statement made by any Examiner or any other official or employee of the Patent and Trademark Office unless such statement is specifically and without qualification or reservation expressly adopted in a responsive writing by Applicants.

The terms and expressions that have been employed are used as terms of description and not of limitation, and there is no intent in the use of such terms and expressions to exclude any equivalent of the features shown and described or portions thereof, but it is recognized that various modifications are possible within the scope of the invention as claimed. Thus, it will be understood that although the present invention has been specifically disclosed by preferred embodiments and optional features, modification and variation of the concepts herein disclosed may be resorted to by those skilled in the art, and such modifications and variations are considered to be within the scope of this invention as defined by the appended claims.

The invention has been described broadly and generically herein. Each of the narrower species and subgeneric groupings falling within the generic disclosure also form part of the invention. This includes the generic description of the invention with a proviso or negative limitation removing any subject matter from the genus, regardless of whether or not the excised material is specifically recited herein.

SEQUENCE LISTING (1116 sequences)

SEQ ID NO: 1 - protein, 219 aa, Homo Sapiens
DVVMTQSPLSLPVTLGQPASISCRSSQSLVYSDGNTYLNWFQQRPGQSPRRLIYKVSNWDSGVPDRFNGSGSGTDFTLKISRVEAEDVGVYYCMQSTHWPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2 - protein, 219 aa, Homo Sapiens
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCIQGTHWPTTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3 - protein, 219 aa, Homo Sapiens
DVVMTQSPLSLPVTLGQPASISCRSSQSLVYSDGNTYLNWLQQRPGQSPRRLIYKVSNWDSGVPDRFSGSGSGTDFTLKISRVEAEDVGVYYCMQGTHWPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4 - protein, 219 aa, Homo Sapiens
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQGIQLPCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5 - protein, 219 aa, Homo Sapiens
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6 - protein, 219 aa, Homo Sapiens
DIVMTQTPLSLSVTPGQPASISCKSSQSLLHSDGKTYLYWFLQKPGQPPQPLIYEVSNRFSGVPDRFSGSGSGTDFTLKISRVEAEDVGVYYCMQSIQLPITFGHGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7 - protein, 214 aa, Homo Sapiens
DIQMTQSPSSLSASVGDRVTITCRASQGIANYLAWYQQKPGKVPKLLIYVASTLQSGVPSRFSGSGSGTDFTLTISSLQPEDVATYYCQNYNSAPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8 - protein, 214 aa, Homo Sapiens
DIQMTQSPSSLSASVGDRVTIICRASQGISNDLAWYQQKPGKVPKLLIYAASTLQSGVPSRFSGSGSGTDFTLTISSLQPEDVATYYCQKYNSVPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9 - protein, 219 aa, Homo Sapiens
NIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPHTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10 - protein, 219 aa, Homo Sapiens
EIVMTQTPLSSPVTLGQPASISCRSSQSLVHSDGNTYLSWLQQRPGQPPRLLIYKISNRFSGVPDRFSGTGAGTDFTLKISRVEAEDVGVYYCMQATQFPHTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11 - protein, 215 aa, Homo Sapiens
EIVLTQSPGTLSLSPGERATLSCRASQTVISSYLAWYQQKPGQAPRLLISGASSRATGIPDRFSGSGSGTDFTLTISRLEPEDFAVYYCQQYGSSPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12 - protein, 213 aa, Homo Sapiens
EIVLTQSPGTLSLSPGERATLSCRASQSVSRLAWYQQKPGQAPRLLIYGASRRATGIPDRFSGSGSGTDFTLTISRLEPEDFAVYYCQQYGSSPRSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13 - protein, 214 aa, Homo Sapiens
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14 - protein, 220 aa, Homo Sapiens
DIVMTQSPDSLAVSLGERATINCKSSQSVLYSSNNKNYLVWYQQKPGQPPKLFIYWASTRESGVPDRFTGSGSGTDFTLTISSLQAEDVAVYYCQQYYSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15 - protein, 220 aa, Homo Sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16 - protein, 220 aa, Homo Sapiens
DIVMTQSPDSLAVSLGERATINCKSSQNVLYSSNNKNYLAWYQQKPGQPPKLLIYWASTRESGVPDRFSGSGSGTDFTLTISSLQAEDVAVYFCQQYYGTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17 - protein, 220 aa, Homo Sapiens; identical to SEQ ID NO: 16

SEQ ID NO: 18 - protein, 220 aa, Homo Sapiens
DIVMTQSPDSLTVSLGERATINCKSSQSVLYSSNNKNYLAWYQQKPGQPPKLLIYWASTRESGVPDRFGGSGSGTDFTLTISSLQAEDVAVYYCQQYYSISRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19 - protein, 220 aa, Homo Sapiens
DIVMTQSPDSLAVSLGERATINCKSSQSVLYNSNNKNYLAWYQQKPGQPPKLLIYWASTRESGVPDRFSGSGSGTDFTLTISSLQADDVAVYYCQQYYSTTWTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20 - protein, 220 aa, Homo Sapiens; identical to SEQ ID NO: 19

SEQ ID NO: 21 - protein, 220 aa, Homo Sapiens
DIVMTQSPDSLAVSLGERATINCKSSQSVLYSSNNKNYLAWYQQKPGQPPKVLIYWASTRKSGVPDRFSGSGSGTDFTLTISGLQAEDVALYYCQQYYSTMFSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22 - protein, 220 aa, Homo Sapiens
DIVMTQSPDSLAVSLGERATINCKSSQSVLDSSNNKNYLAWYQQKPGQPPKLLIYWASTRESGVPDRFSGSGSGTDFTLTISSLQAEDVAVFYCHQYYSTPLTFGGGTKVAIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 23 - protein, 220 aa, Homo Sapiens
DIVMTQSPDSLAVSLGERATINCKSSQSILYRSNNKNYLAWYQQKPGQPPKLLIYWASARESGVPDRFSGSGSGTDFTLTISSLQAEDVAVYFCQQYFITPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24 - protein, 214 aa, Homo Sapiens
DIQMTQSPSSLSASVGDRVTITCRASQDISHYLAWFQQKPGKAPKSLIYAASSLQSGVPSKFSGSGSGTDFTLTISSLQPEDFATYYCQQYNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25 - protein, 214 aa, Homo Sapiens
DIQMTQSPSSLSASVGDRVAITCRASQDISNYLAWLQQKPGKAPKSLIYAASSLQSGVPSRFSGSGSGTDFTLTISSLQPEDFATYYCQQYNTYPFTFGPGTKMDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26 - protein, 215 aa, Homo Sapiens
EIVMTQSPATLSVSPGERATLSCRASQSVSSNLAWYQQDPGQAPRLLIYGASRRATGIPARFSGSGSGTEFTLTISSLQSEDFAVYYCQQHNNWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27 - protein, 214 aa, Homo Sapiens
DIQMTQSPSSVSASVGDRVTITCRASQDISRWLAWYQQKPGKAPKLLIYAASSLQSGVPSRFSGSGSGTDFTLTISSLQPEDFATYYCQQANSFPPTFGQGTKVEFKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28 - protein, 214 aa, Homo Sapiens
DIQMTQSPSSLSASVGDRVTITCRASQSISTYLNWYQQKPGKAPKFLIYAASSLQSGVPSRFSGSGSGTDFTLTISSLQPEDFAAYYCQQSHSAPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 29 - protein, 213 aa, Homo Sapiens
DIQMTQSPSSLSASLGDRVTITCRASQTISIYLNWYQQKPGKAPKLLIYAASSLQSGVPSRFSGSGSGTDFTLTISSLQPEDFATYYCQQSYSTLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 30 - protein, 214 aa, Homo Sapiens
DIQMTQSPSSLSASVGDRVTITCRASQSIRSYLNWYQQRPGNAPKLLIYAASSLQSGVPSRVSGSGSGTDFTLTIRSLQPEDFATYYCQQSYSIPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 31 - protein, 214 aa, Homo Sapiens
DIQMTQSPSSRSASVGDRVTITCRASQTISRYLNWYQQKPGKAPKLLIYAASTLQSGVPSRFSGSGSGTDFTLTLSSLQPEDFATYYCQQIYSTSITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32 - protein, 214 aa, Homo Sapiens
DIQMTQSPSSLSASVGDRVTITCRASQRISSYLNWYQQKPGKAPKVLIYAESSLQSGVPSRFSGSGSGTDFTLTISSLQPEDFATYYCQQSYITPITFGQGTRLEIIRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33 - protein, 214 aa, Homo Sapiens
DIQMTQSPSSLSASVGDRVTITCRASQSISRYLNWYQQKPGKAPKLLIYTASSLQSGVPSRFSGSGSGTDFTLTISSLQPENFATYYCQQSYFTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 34 - protein, 214 aa, Homo Sapiens
DIQMTQSPSSLSASVGDRVTITCRASQSISSYLNWYQQKPGKAPKLLIYTASSLQSGVPSRFSGSGSGTDFTLTFSSLQPEDFATYYCQQSYFSPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35 - protein, 433 aa, Homo Sapiens
DIQMTQSPSSLSASVGDRVTITCRASQSISSYLNWYQQKPGKAPKLLIYTASSLQSGVPSRFSGSGSGTDFTLTLSSLQPEDFASYYCQQSFYTPITFGQGTRLEIKASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 36 - protein, 214 aa, Homo Sapiens
DIQMTQSPSSLSASVGDRVTITCRASQSISSYLNWYQQKPGKAPKLLIYTVSSLQSGVPSRFSGSGSGTDFTLTISSLQPEDFATYYCQQSYFTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 37 - protein, 214 aa, Homo Sapiens
DIQMTQSPSSLSASVGDRVTITCRASQSISSYLNWYQQKPGKAPKLLIYTASSLQSGVPSRFSGSGSGTDFTLTISSLQPEDFASYYCQQSFYAPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 38 - protein, 214 aa, Homo Sapiens
DIQMTQSPSSLSASVGDRVTITCRASQSISSYLNWYQQKPGKAPKLLIYTASSLQSGVPSRFSGSGSGTDFTLTISSLQPEDFATYYCQQSYFTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 39 - protein, 214 aa, Homo Sapiens
DIQMTQSPSSLSASVGDRVTITCQASQDISNYLNWYQQKPGKAPKLLIYDASNLETGVPSRFSGSGSGTDFTFTISSLQPEDIATYYCQQYDYLPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 40 - protein, 214 aa, Homo Sapiens
DIQMTQSPSSLSASVGDRVTITCQASQDISNSLNWYQQKPGKAPELLIYDASNLETGVPSRFSGSGSGTDFTFTISSLQPEDIATYYCQQCDDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41 - protein, 214 aa, Homo Sapiens
DIQMTQSPSSLSASVGDRVTITCQASQDISDYLNWYQQKPGKAPKLLIYDASNLETGVPSRFSGSGSGTDFTFTISSLQPEDIATYYCQHYDNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42 - protein, 214 aa, Homo Sapiens
DIQMTQSPSSLSASVGDRVAITCQASQDISNYLNWYQQKPGKAPKLLIYDASNLETGVPSRFSGSGSGTDFTFTISSLQPEDIATYYCQQYDNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 43 - protein, 214 aa, Homo Sapiens
DIQMTQSPSSLSASVGDRVTITCQASQDISNSLNWYQQKPGKAPKLLIYDASILETGVPSRFSGSGSETDFTFTISSLQPEDIATYYCQQCDILPLSFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 44 - protein, 214 aa, Homo Sapiens
DIQMTQSPSSLSASVGDRVTITCQASQDISNSLNWYQQKPGKAPKLLIYDASNLETGVPSRFSGSGSGTDFTFTISSLQPEDIATYYCQQYDNLPLAFGGGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 45 - protein, 214 aa, Homo Sapiens
DIQMTQSPSSLSASVGDGVTITCQASQDITNYLNWYQQKPGKAPKLLIYDASNLETGVPSRFSGSGSGTDFTFTISSLQPEDIATYYCQQYDSLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 46 - protein, 214 aa, Homo Sapiens
DIQMTQSPSSLSASVGDRVTITCQASQDISNYLNWYQQKLGKAPKLLIHDASNLETGVPSRFSGSGSGTDFTFTISSLQPEDIATYYCQQYDNLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 47 - protein, 214 aa, Homo Sapiens
DIQMTQSPSSLSASVGDRVTITCQASQDISDYLNWYQQKPGKAPKLLIYDASNLETGVPSRFSGSGSGTDFTFTISSLQPEDIATYYCQHYDNLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 48 - protein, 214 aa, Homo Sapiens
DIQMTQSPSSLSASVGDRVTITCQASQDISNSLNWYQQKPGKAPKLLIYDASNLETGVPSRFSGSGSGTDFTFTISSLQPEDIATYYCQHYDNLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 49 - protein, 446 aa, Homo Sapiens
QVQLVQSGAEVKKPGASVKVSCKASGYTFTSYGISWVRQAPGQGLEWMGWISASNGNTNYAQKLQDRVTMTTDTSTSTAYMELRSLRSDDTAVYYCAREDNWNYGFFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 50 - protein, 443 aa, Homo Sapiens
QVHLVQSGAEVKKPGASVKVSCKVSGYTFTGHYMHWVRQAPGQGLEWMGWINPNSGGTNCAQKFQGRVTMTRDTSISTAYMELSRLRSDDTAVYYCARSIAVALDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 51 - protein, 443 aa, Homo Sapiens
QVQLVQSGAEVKKPGASVKVSCKASGYTFTGYYMHWVRQAPGQGLEWMGWINPNSGGTNHTQKFQGRVTMTRDTSISTAYMELSRLRSDDTAVYYCARSIAVALDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 52 - protein, 448 aa, Homo Sapiens
QVQLVQSGAEVRKPGASVKVSCKVSGYTLTELSMHWVRQAPGKGLEWMGSFDPEDGETIYAQKFQGRVTMLEDTSTDTAYMELSSLRSEDTAVYYCATEGDGGYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 53 - protein, 448 aa, Homo Sapiens
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARMYSSGWYGVFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 54 - protein, 449 aa, Homo Sapiens
QVTLKESGPVLVKPTETLTLTCTVSGFSLSNARMGVSWIRQPPGKALEWLVLIFSNDEKSYSTSLKSRLTISKDTSKSQVVLTMTNMDPVDTATYYCARVYSSGWSFYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 55 - protein, 444 aa, Homo Sapiens
QITLKESGPTLVKPTQTLTLTCTFSGFSLSTGGVGVGWIRQPPGKALEWLALIYWNDDKRYSPSLKSRLTITKDTSKNQVVLTMTNMDPVDTATYYCAHRRELPFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 56 - protein, 444 aa, Homo Sapiens
QITLKESGPTLVKPTQTLTLTCTFSGFSLSTGGVGVGWIRQPPGKALEWLALIYWNDDKRYSPSLKSRLTITKDTSKTQVVLTVTDMDPVDTATYYCAHRNWTPFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 57 - protein, 444 aa, Homo Sapiens
QITLKESGPTLVKPTQTLTLTCTFSGFSLNTGGVGVGWIRQPPGKALEWLALIYWNDDKRYSPSLKSRLTITKDTSKNQVVLTMTNMDPVDTATYYCAHRLELPFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 58 - protein, 444 aa, Homo Sapiens
QITLKESGPTLVKPTQTLTLTCTFSGFSLSTGGVGVGWIRQPPGKALEWLALIYWNDDKRYSPSLKSRLTITKDTSKNQVVLTMTNLDPVDTATYYCAHRREVPFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 59 - protein, 444 aa, Homo Sapiens
QITLKESGPTLVKPTQTLTLTCTFSGFSLSTGGVGVGWIRQPPGKALEWLALIYWNVEKRYSPSLRSRLTITKATSKNQVVLTMTNMDPVDTATYYCAHRHTNPFEYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 60 - protein, 444 aa, Homo Sapiens
QITLKESGPTLVKPTQTLTLTCTFSGFSLSTGGVGVGWIRQPPGKALEWLALIYWNDDKRYSPSLKSRLTITKDTSKNQVVLTMTNMDPVDTATYYCAHRGELPFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 61 - protein, 447 aa, Homo Sapiens
EVQLVESGGGLVKPGGSLRLSCAASGFPFSRYSMNWVRQAPGKGLEWVSAISSSSSYIYYADSVKGRFTISRDNAKNSLYLQMNSLRAEDTAVYYCARDRVGATPDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 62 - protein, 454 aa, Homo Sapiens
EVQLLESGGGLVQPGGSLRLSCAASGFTFSSYAMNWVRQAPGKGLEWVSAISGSGGSTYYADSVKGRFTISRDNSKNTLYLQMNSLRAEDTAVYYCAKEGIAVAGTAEYYYYYAMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 63 - protein, 451 aa, Homo Sapiens
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEGIAARDSYYYYAMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 64 - protein, 451 aa, Homo Sapiens
EVQLLESGGGLVQPGGSLRLSCTASGFTFSSYAMSWVRQAPGKGLEWVSAISGSGGSTYYADSVKGRFTISRDNSKNTLYLQMNSLRAEDTAEYYCAKEGIAGRDSYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 65 - protein, 449 aa, Homo Sapiens
QVQLVESGGGVVQPGRSLRLSCAASGFTFSSYGMHWVRQAPGKGLEWVAFISDDGSTKYYADSVKGRFTISRDNSMNTLYLQMNSLRAEDTAVYYCARSYYDSSGYYYGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 66 - protein, 440 aa, Homo Sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARNVIDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 67 - protein, 446 aa, Homo Sapiens
QVQLVESGGGVVQPGRSLRLSCAASGFTFSSYDMHWVRQAPGKGLEWVAVIWYDGSIKYYADSVKGRFTISRDNSKNTLYLQMNSLRAEDTAVYYCARGGATGAEYFQHWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 68 - protein, 444 aa, Homo Sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCVLLWFGETFDYWGQGSLVTVSPASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 69 - protein, 441 aa, Homo Sapiens
QVQLVESGGGVVQPGRSLRLSCAASGFTFSSYGMHWVRQAPGKGLEWVAVIWSDGSNKYYADSVKGRFTISRDNSKNTLYLQMNSLRAEDTAVYYCARNLPFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 70 - protein, 449 aa, Homo Sapiens
QVQLVESGGGVVQPGRSLRLSCAASGFTFSSYGMHWVRQAPGKGLEWVAVIWDDGSNQYYTDSVKGRFTVSRDNSKNTLFLQMNSLRAEDTAVYYCARSHYGGDYDYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 71 - protein, 446 aa, Homo Sapiens
QVQLVESGGGVVQPGRSLRLSCAASGFTFSSYGMHWVRQAPGKGLEWVAVIWYDGSNKRYVDSVKGRFTISRDNSKNTLYLQMNSLRAEDTAVYYCARDGWQQQAPFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 72 - protein, 444 aa, Homo Sapiens
QVQLVESGGGVVQPGRSLRLSCAASGFTFRSHGMHWVRQAPGKGLEWVAVIWYDGSNKNYADSVRGRFTISRDNSKNTLDLQMNSLRAEDTAVYYCARWGISAPFDCWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 73 - protein, 441 aa, Homo Sapiens
EVQLVESGGGLVQPGGSLRLSCAASGFTFSAYSMNWVRQAPGKGLEWVSYISSSGRTIYYADSVKGRFTISRDNAKNSLFLQMNSLRDEDTAVYYCALWAPFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 74 - protein, 451 aa, Homo Sapiens
EVQLVESGGGLVQPGGSLRLSCAASGFTFSSYSMNWVRQAPGKGLEWVSHISSSSRTIYYADSVKGRFTISRDNAKNSVYLQMNSLRDEDTAVYYCARDGYNWNGGGNYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 75 - protein, 451 aa, Homo Sapiens
EVQLVESGGGLVQPGGSLRLSCAASGFTFSSYSMNWVRQAPGKGLEWVSHISRSSRTIYYADSVKGRFTISRDNAKNSLYLQMNSLRDEDTAVYYCARDGYNWNNGGYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 76 - protein, 444 aa, Homo Sapiens
QVQLQESGPGLVKPSQTLSLTCTVSGGSVSSGGYYWSWIRQHPGKGLEWIGYIHSSGSTYYNPSLKSRVTISVDTSKNQFSLNLSSVTAADTAVYYCARGPYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 77 - protein, 453 aa, Homo Sapiens
QVQLQESGPGLVKPSQTLSLTCTVSGGSISRGGYYWSWIRQHPGKGLEWIGYIYHSGSTYYNPSLKSRVNMSVDTSKNQFSLKLSSVTAADTAVYYCARALRGIVLMVYVLGALDIWGQGTKVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 78 - protein, 453 aa, Homo Sapiens
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARDETVVRGLIRYCYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 79 - protein, 448 aa, Homo Sapiens
QVQLQESGPGLVKPSQTLSLNCTVSGGSISSGGYYWSWIRQHPGKGLEWIGYIHYSGSTYYNPSLKSRITISADTSKNQFSLKLNSVTAADTAVYYCARDRGGGDYGRMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 80 - protein, 448 aa, Homo Sapiens; identical to SEQ ID NO: 79

SEQ ID NO: 81 - protein, 445 aa, Homo Sapiens
QVQLQESGPGLVKPSQTLSLTCTVSGGSISSGGYYWSWIRQHPGKGLEWIGYIHSSGSTYYNPSLKSRITKSVDTSKNQFSLKLSSVTAADTAVYYCARSNNYGCFALWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 82 - protein, 445 aa, Homo Sapiens; identical to SEQ ID NO: 81

SEQ ID NO: 83 - protein, 459 aa, Homo Sapiens
QVQLQESGPGLVKPSQTLSLTCTVSGGSISSGGYYWSWIRQHPGKGLEWIGYIHYSGSTYYNPSLKSRVTISVDTSKNQFSLKLSSVTAADTAVYYCASGYNYGLYYYDSSGYPSYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 84 - protein, 451 aa, Homo Sapiens
QVQLQESGPGLVKPSQTLSLTCTVSGGSISSGDYYWNWVRQHPGKGLEWIGYIYYSGGTYYNPSLKSRVTISVDTSKNQFSLKLFSVTAADTAVYFCARTYYDILTGYPFYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 85 - protein, 451 aa, Homo Sapiens; identical to SEQ ID NO: 84

SEQ ID NO: 86 - protein, 446 aa, Homo Sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGYSSSWYWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 87 - protein, 446 aa, Homo Sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGYSSSWFWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 88 - protein, 449 aa, Homo Sapiens
QVQLQESGPGLVKPSETLSLTCTVSGGSISSYYWSWIRQPAGKGLEWIGRIYTSGTTNYNPSLKSRVTMSVDTSKNQFSLKLSSVTAADTAVYYCARDGYSYGHYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 89 - protein, 452 aa, Homo Sapiens
QVQLQESGPGLVKPSETLSLTCTVSGGSVSSGGSYWSWIRQPPGKGLEWIGYIYYSGSTNYNPSLKSRVTISIVTSRNQFSLKLSSVTAADTAVYYCARSALRYFDWLFSDVSDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 90 - protein, 446 aa, Homo Sapiens
EVQLVQSGAELKKPGESLKISCKGSGYRFTSYWIGWVRQMPGKGLEWMGIIYPDDSDTRYSPSFQGQVTISADKSISTAYLQWSSLKASDTAMYYCARQKSYGYSYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 91 - protein, 447 aa, Homo Sapiens
EVQLVQSGAEVKKPGESLKISCKGSGYSFTSYWIGWVRQMPGKGLEWMGIIYPDDSDARYSPSFQGQVTISADKSINTAYLQWSSLKASDTAMYYCARQGYGSGWGYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 92 - protein, 453 aa, Homo Sapiens
EVQLVQSGAEVKKPGESLKISCKGSGYSFTSYWIGWVRQMPGKGLEWMGIIYPGDSDIRYSPSFQGQVTISADKSISTAYLQWSSLKASDTAMYYCARQGLAVAGTSYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 93 - protein, 451 aa, Homo Sapiens
QVQLQQSGPGLVKPSQTLSLTCAISGDSVSSYSAAWNWIRQSPSRGLEWLGRTYCRSKWYNDYAVSVKSRITINPDTSKNQFSLQLNSVTPEDTAVYYCARDRAVAGYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 94 - protein, 112 aa, Homo Sapiens
DVVMTQSPLSLPVTLGQPASISCRSSQSLVYSDGNTYLNWFQQRPGQSPRRLIYKVSNWDSGVPDRFNGSGSGTDFTLKISRVEAEDVGVYYCMQSTHWPITFGQGTRLEIK

SEQ ID NO: 95 - protein, 112 aa, Homo Sapiens
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCIQGTHWPTTFGQGTRLEIK

SEQ ID NO: 96 - protein, 112 aa, Homo Sapiens
DVVMTQSPLSLPVTLGQPASISCRSSQSLVYSDGNTYLNWLQQRPGQSPRRLIYKVSNWDSGVPDRFSGSGSGTDFTLKISRVEAEDVGVYYCMQGTHWPITFGQGTRLEIK

SEQ ID NO: 97 - protein, 112 aa, Homo Sapiens
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQGIQLPCSFGQGTKLEIK

SEQ ID NO: 98 - protein, 112 aa, Homo Sapiens
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPLTFGGGTKVEIK

SEQ ID NO: 99 - protein, 112 aa, Homo Sapiens
DIVMTQTPLSLSVTPGQPASISCKSSQSLLHSDGKTYLYWFLQKPGQPPQPLIYEVSNRFSGVPDRFSGSGSGTDFTLKISRVEAEDVGVYYCMQSIQLPITFGHGTRLEIK

SEQ ID NO: 100 - protein, 107 aa, Homo Sapiens
DIQMTQSPSSLSASVGDRVTITCRASQGIANYLAWYQQKPGKVPKLLIYVASTLQSGVPSRFSGSGSGTDFTLTISSLQPEDVATYYCQNYNSAPFTFGPGTKVDIK

SEQ ID NO: 101 - protein, 107 aa, Homo Sapiens
DIQMTQSPSSLSASVGDRVTIICRASQGISNDLAWYQQKPGKVPKLLIYAASTLQSGVPSRFSGSGSGTDFTLTISSLQPEDVATYYCQKYNSVPLTFGGGTKVEIK

SEQ ID NO: 102 - protein, 112 aa, Homo Sapiens
NIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPHTFGPGTKVDIK

SEQ ID NO: 103 - protein, 112 aa, Homo Sapiens
EIVMTQTPLSSPVTLGQPASISCRSSQSLVHSDGNTYLSWLQQRPGQPPRLLIYKISNRFSGVPDRFSGTGAGTDFTLKISRVEAEDVGVYYCMQATQFPHTFGGGTKVEIK

SEQ ID NO: 104 - protein, 108 aa, Homo Sapiens
EIVLTQSPGTLSLSPGERATLSCRASQTVISSYLAWYQQKPGQAPRLLISGASSRATGIPDRFSGSGSGTDFTLTISRLEPEDFAVYYCQQYGSSPRTFGQGTKVEIK

SEQ ID NO: 105 - protein, 106 aa, Homo Sapiens
EIVLTQSPGTLSLSPGERATLSCRASQSVSRLAWYQQKPGQAPRLLIYGASRRATGIPDRFSGSGSGTDFTLTISRLEPEDFAVYYCQQYGSSPRSFGQGTKLEIK

SEQ ID NO: 106 - protein, 107 aa, Homo Sapiens
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPPTFGQGTKVEIK

SEQ ID NO: 107 - protein, 113 aa, Homo Sapiens
DIVMTQSPDSLAVSLGERATINCKSSQSVLYSSNNKNYLVWYQQKPGQPPKLFIYWASTRESGVPDRFTGSGSGTDFTLTISSLQAEDVAVYYCQQYYSFPWTFGQGTKVEIK

SEQ ID NO: 108 - protein, 113 aa, Homo Sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTTWTFGQGTKVEIK

SEQ ID NO: 109 - protein, 113 aa, Homo Sapiens
DIVMTQSPDSLAVSLGERATINCKSSQNVLYSSNNKNYLAWYQQKPGQPPKLLIYWASTRESGVPDRFSGSGSGTDFTLTISSLQAEDVAVYFCQQYYGTPRTFGQGTKVEIK

SEQ ID NO: 110 - protein, 113 aa, Homo Sapiens; identical to SEQ ID NO: 109

SEQ ID NO: 111 - protein, 113 aa, Homo Sapiens
DIVMTQSPDSLTVSLGERATINCKSSQSVLYSSNNKNYLAWYQQKPGQPPKLLIYWASTRESGVPDRFGGSGSGTDFTLTISSLQAEDVAVYYCQQYYSISRTFGQGTKVEIK

SEQ ID NO: 112 - protein, 113 aa, Homo Sapiens
DIVMTQSPDSLAVSLGERATINCKSSQSVLYNSNNKNYLAWYQQKPGQPPKLLIYWASTRESGVPDRFSGSGSGTDFTLTISSLQADDVAVYYCQQYYSTTWTFGPGTKVEIK

SEQ ID NO: 113 - protein, 113 aa, Homo Sapiens; identical to SEQ ID NO: 112

SEQ ID NO: 114 - protein, 113 aa, Homo Sapiens
DIVMTQSPDSLAVSLGERATINCKSSQSVLYSSNNKNYLAWYQQKPGQPPKVLIYWASTRKSGVPDRFSGSGSGTDFTLTISGLQAEDVALYYCQQYYSTMFSFGQGTKLEIK

SEQ ID NO: 115 - protein, 113 aa, Homo Sapiens
DIVMTQSPDSLAVSLGERATINCKSSQSVLDSSNNKNYLAWYQQKPGQPPKLLIYWASTRESGVPDRFSGSGSGTDFTLTISSLQAEDVAVFYCHQYYSTPLTFGGGTKVAIK

SEQ ID NO: 116 - protein, 113 aa, Homo Sapiens
DIVMTQSPDSLAVSLGERATINCKSSQSILYRSNNKNYLAWYQQKPGQPPKLLIYWASARESGVPDRFSGSGSGTDFTLTISSLQAEDVAVYFCQQYFITPLTFGGGTKVEIK

SEQ ID NO: 117 - protein, 107 aa, Homo Sapiens
DIQMTQSPSSLSASVGDRVTITCRASQDISHYLAWFQQKPGKAPKSLIYAASSLQSGVPSKFSGSGSGTDFTLTISSLQPEDFATYYCQQYNNYPFTFGPGTKVDIK

SEQ ID NO: 118 - protein, 107 aa, Homo Sapiens
DIQMTQSPSSLSASVGDRVAITCRASQDISNYLAWLQQKPGKAPKSLIYAASSLQSGVPSRFSGSGSGTDFTLTISSLQPEDFATYYCQQYNTYPFTFGPGTKMDIK

SEQ ID NO: 119 - protein, 108 aa, Homo Sapiens
EIVMTQSPATLSVSPGERATLSCRASQSVSSNLAWYQQDPGQAPRLLIYGASRRATGIPARFSGSGSGTEFTLTISSLQSEDFAVYYCQQHNNWPPWTFGQGTKVEIK

SEQ ID NO: 120 - protein, 107 aa, Homo Sapiens
DIQMTQSPSSVSASVGDRVTITCRASQDISRWLAWYQQKPGKAPKLLIYAASSLQSGVPSRFSGSGSGTDFTLTISSLQPEDFATYYCQQANSFPPTFGQGTKVEFK

SEQ ID NO: 121 - protein, 107 aa, Homo Sapiens
DIQMTQSPSSLSASVGDRVTITCRASQSISTYLNWYQQKPGKAPKFLIYAASSLQSGVPSRFSGSGSGTDFTLTISSLQPEDFAAYYCQQSHSAPFTFGPGTKVDIK

SEQ ID NO: 122 - protein, 106 aa, Homo Sapiens
DIQMTQSPSSLSASLGDRVTITCRASQTISIYLNWYQQKPGKAPKLLIYAASSLQSGVPSRFSGSGSGTDFTLTISSLQPEDFATYYCQQSYSTLTFGGGTKVEIK

SEQ ID NO: 123 - protein, 107 aa, Homo Sapiens
DIQMTQSPSSLSASVGDRVTITCRASQSIRSYLNWYQQRPGNAPKLLIYAASSLQSGVPSRVSGSGSGTDFTLTIRSLQPEDFATYYCQQSYSIPLTFGGGTKVEIK

SEQ ID NO: 124 - protein, 107 aa, Homo Sapiens
DIQMTQSPSSRSASVGDRVTITCRASQTISRYLNWYQQKPGKAPKLLIYAASTLQSGVPSRFSGSGSGTDFTLTLSSLQPEDFATYYCQQIYSTSITFGQGTRLEIK

SEQ ID NO: 125 - protein, 107 aa, Homo Sapiens
DIQMTQSPSSLSASVGDRVTITCRASQRISSYLNWYQQKPGKAPKVLIYAESSLQSGVPSRFSGSGSGTDFTLTISSLQPEDFATYYCQQSYITPITFGQGTRLEII

SEQ ID NO: 126 - protein, 107 aa, Homo Sapiens
DIQMTQSPSSLSASVGDRVTITCRASQSISRYLNWYQQKPGKAPKLLIYTASSLQSGVPSRFSGSGSGTDFTLTISSLQPENFATYYCQQSYFTPITFGQGTRLEIK

SEQ ID NO: 127 - protein, 107 aa, Homo Sapiens
DIQMTQSPSSLSASVGDRVTITCRASQSISSYLNWYQQKPGKAPKLLIYTASSLQSGVPSRFSGSGSGTDFTLTFSSLQPEDFATYYCQQSYFSPITFGQGTRLEIK

SEQ ID NO: 128 - protein, 107 aa, Homo Sapiens
DIQMTQSPSSLSASVGDRVTITCRASQSISSYLNWYQQKPGKAPKLLIYTASSLQSGVPSRFSGSGSGTDFTLTLSSLQPEDFASYYCQQSFYTPITFGQGTRLEIK

SEQ ID NO: 129 - protein, 107 aa, Homo Sapiens
DIQMTQSPSSLSASVGDRVTITCRASQSISSYLNWYQQKPGKAPKLLIYTVSSLQSGVPSRFSGSGSGTDFTLTISSLQPEDFATYYCQQSYFTPITFGQGTRLEIK

SEQ ID NO: 130 - protein, 107 aa, Homo Sapiens
DIQMTQSPSSLSASVGDRVTITCRASQSISSYLNWYQQKPGKAPKLLIYTASSLQSGVPSRFSGSGSGTDFTLTISSLQPEDFASYYCQQSFYAPITFGQGTRLEIK

SEQ ID NO: 131 - protein, 107 aa, Homo Sapiens
DIQMTQSPSSLSASVGDRVTITCRASQSISSYLNWYQQKPGKAPKLLIYTASSLQSGVPSRFSGSGSGTDFTLTISSLQPEDFATYYCQQSYFTPITFGQGTRLEIK

SEQ ID NO: 132 - protein, 107 aa, Homo Sapiens
DIQMTQSPSSLSASVGDRVTITCQASQDISNYLNWYQQKPGKAPKLLIYDASNLETGVPSRFSGSGSGTDFTFTISSLQPEDIATYYCQQYDYLPFTFGPGTKVDIK

SEQ ID NO: 133 - protein, 107 aa, Homo Sapiens
DIQMTQSPSSLSASVGDRVTITCQASQDISNSLNWYQQKPGKAPELLIYDASNLETGVPSRFSGSGSGTDFTFTISSLQPEDIATYYCQQCDDLPLTFGGGTKVEIK

SEQ ID NO: 134 - protein, 107 aa, Homo Sapiens
DIQMTQSPSSLSASVGDRVTITCQASQDISDYLNWYQQKPGKAPKLLIYDASNLETGVPSRFSGSGSGTDFTFTISSLQPEDIATYYCQHYDNLPLTFGGGTKVEIK

SEQ ID NO: 135 - protein, 107 aa, Homo Sapiens
DIQMTQSPSSLSASVGDRVAITCQASQDISNYLNWYQQKPGKAPKLLIYDASNLETGVPSRFSGSGSGTDFTFTISSLQPEDIATYYCQQYDNLPLTFGGGTKVEIK

SEQ ID NO: 136 - protein, 107 aa, Homo Sapiens
DIQMTQSPSSLSASVGDRVTITCQASQDISNSLNWYQQKPGKAPKLLIYDASILETGVPSRFSGSGSETDFTFTISSLQPEDIATYYCQQCDILPLSFGGGTKVEIK

SEQ ID NO: 137 - protein, 107 aa, Homo Sapiens
DIQMTQSPSSLSASVGDRVTITCQASQDISNSLNWYQQKPGKAPKLLIYDASNLETGVPSRFSGSGSGTDFTFTISSLQPEDIATYYCQQYDNLPLAFGGGTKVEIR

SEQ ID NO: 138 - protein, 107 aa, Homo Sapiens
DIQMTQSPSSLSASVGDGVTITCQASQDITNYLNWYQQKPGKAPKLLIYDASNLETGVPSRFSGSGSGTDFTFTISSLQPEDIATYYCQQYDSLPITFGQGTRLEIK

SEQ ID NO: 139 - protein, 107 aa, Homo Sapiens
DIQMTQSPSSLSASVGDRVTITCQASQDISNYLNWYQQKLGKAPKLLIHDASNLETGVPSRFSGSGSGTDFTFTISSLQPEDIATYYCQQYDNLPITFGQGTRLEIK

SEQ ID NO: 140 - protein, 107 aa, Homo Sapiens
DIQMTQSPSSLSASVGDRVTITCQASQDISDYLNWYQQKPGKAPKLLIYDASNLETGVPSRFSGSGSGTDFTFTISSLQPEDIATYYCQHYDNLPITFGQGTRLEIK

SEQ ID NO: 141 - protein, 107 aa, Homo Sapiens
DIQMTQSPSSLSASVGDRVTITCQASQDISNSLNWYQQKPGKAPKLLIYDASNLETGVPSRFSGSGSGTDFTFTISSLQPEDIATYYCQHYDNLPITFGQGTRLEIK

SEQ ID NO: 142 - protein, 120 aa, Homo Sapiens
QVQLVQSGAEVKKPGASVKVSCKASGYTFTSYGISWVRQAPGQGLEWMGWISASNGNTNYAQKLQDRVTMTTDTSTSTAYMELRSLRSDDTAVYYCAREDNWNYGFFDYWGQGTLVTVSS

SEQ ID NO: 143 - protein, 117 aa, Homo Sapiens
QVHLVQSGAEVKKPGASVKVSCKVSGYTFTGHYMHWVRQAPGQGLEWMGWINPNSGGTNCAQKFQGRVTMTRDTSISTAYMELSRLRSDDTAVYYCARSIAVALDYWGQGTLVTVSS

SEQ ID NO: 144 - protein, 117 aa, Homo Sapiens
QVQLVQSGAEVKKPGASVKVSCKASGYTFTGYYMHWVRQAPGQGLEWMGWINPNSGGTNHTQKFQGRVTMTRDTSISTAYMELSRLRSDDTAVYYCARSIAVALDYWGQGTLVTVSS

SEQ ID NO: 145 - protein, 122 aa, Homo Sapiens
QVQLVQSGAEVRKPGASVKVSCKVSGYTLTELSMHWVRQAPGKGLEWMGSFDPEDGETIYAQKFQGRVTMLEDTSTDTAYMELSSLRSEDTAVYYCATEGDGGYYYYGMDVWGQGTTVTVSS

SEQ ID NO: 146 - protein, 122 aa, Homo Sapiens
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARMYSSGWYGVFDYWGQGTLVTVSS

SEQ ID NO: 147 - protein, 123 aa, Homo Sapiens
QVTLKESGPVLVKPTETLTLTCTVSGFSLSNARMGVSWIRQPPGKALEWLVLIFSNDEKSYSTSLKSRLTISKDTSKSQVVLTMTNMDPVDTATYYCARVYSSGWSFYGMDVWGQGTTVTVSS

SEQ ID NO: 148 - protein, 118 aa, Homo Sapiens
QITLKESGPTLVKPTQTLTLTCTFSGFSLSTGGVGVGWIRQPPGKALEWLALIYWNDDKRYSPSLKSRLTITKDTSKNQVVLTMTNMDPVDTATYYCAHRRELPFDYWGQGTLVTVSS

SEQ ID NO: 149 - protein, 118 aa, Homo Sapiens
QITLKESGPTLVKPTQTLTLTCTFSGFSLSTGGVGVGWIRQPPGKALEWLALIYWNDDKRYSPSLKSRLTITKDTSKTQVVLTVTDMDPVDTATYYCAHRNWTPFDYWGQGTLVTVSS

SEQ ID NO: 150 - protein, 118 aa, Homo Sapiens
QITLKESGPTLVKPTQTLTLTCTFSGFSLNTGGVGVGWIRQPPGKALEWLALIYWNDDKRYSPSLKSRLTITKDTSKNQVVLTMTNMDPVDTATYYCAHRLELPFDYWGQGTLVTVSS

SEQ ID NO: 151 - protein, 118 aa, Homo Sapiens
QITLKESGPTLVKPTQTLTLTCTFSGFSLSTGGVGVGWIRQPPGKALEWLALIYWNDDKRYSPSLKSRLTITKDTSKNQVVLTMTNLDPVDTATYYCAHRREVPFDYWGQGTLVTVSS

SEQ ID NO: 152 - protein, 118 aa, Homo Sapiens
QITLKESGPTLVKPTQTLTLTCTFSGFSLSTGGVGVGWIRQPPGKALEWLALIYWNVEKRYSPSLRSRLTITKATSKNQVVLTMTNMDPVDTATYYCAHRHTNPFEYWGQGTLVTVSS

SEQ ID NO: 153 - protein, 118 aa, Homo Sapiens
QITLKESGPTLVKPTQTLTLTCTFSGFSLSTGGVGVGWIRQPPGKALEWLALIYWNDDKRYSPSLKSRLTITKDTSKNQVVLTMTNMDPVDTATYYCAHRGELPFDYWGQGTLVTVSS

SEQ ID NO: 154 - protein, 121 aa, Homo Sapiens
EVQLVESGGGLVKPGGSLRLSCAASGFPFSRYSMNWVRQAPGKGLEWVSAISSSSSYIYYADSVKGRFTISRDNAKNSLYLQMNSLRAEDTAVYYCARDRVGATPDAFDIWGQGTMVTVSS

SEQ ID NO: 155 - protein, 128 aa, Homo Sapiens
EVQLLESGGGLVQPGGSLRLSCAASGFTFSSYAMNWVRQAPGKGLEWVSAISGSGGSTYYADSVKGRFTISRDNSKNTLYLQMNSLRAEDTAVYYCAKEGIAVAGTAEYYYYYAMDVWGQGTTVTVSS

SEQ ID NO: 156 - protein, 125 aa, Homo Sapiens
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEGIAARDSYYYYAMDVWGQGTTVTVSS

SEQ ID NO: 157 - protein, 125 aa, Homo Sapiens
EVQLLESGGGLVQPGGSLRLSCTASGFTFSSYAMSWVRQAPGKGLEWVSAISGSGGSTYYADSVKGRFTISRDNSKNTLYLQMNSLRAEDTAEYYCAKEGIAGRDSYYYYGMDVWGQGTTVTVSS

SEQ ID NO: 158 - protein, 123 aa, Homo Sapiens
QVQLVESGGGVVQPGRSLRLSCAASGFTFSSYGMHWVRQAPGKGLEWVAFISDDGSTKYYADSVKGRFTISRDNSMNTLYLQMNSLRAEDTAVYYCARSYYDSSGYYYGFDYWGQGTLVTVSS

SEQ ID NO: 159 - protein, 114 aa, Homo Sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARNVIDYWGQGTLVTVSS

SEQ ID NO: 160 - protein, 120 aa, Homo Sapiens
QVQLVESGGGVVQPGRSLRLSCAASGFTFSSYDMHWVRQAPGKGLEWVAVIWYDGSIKYYADSVKGRFTISRDNSKNTLYLQMNSLRAEDTAVYYCARGGATGAEYFQHWGQGTLVTVSS

SEQ ID NO: 161 - protein, 118 aa, Homo Sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCVLLWFGETFDYWGQGSLVTVSP

SEQ ID NO: 162 - protein, 115 aa, Homo Sapiens
QVQLVESGGGVVQPGRSLRLSCAASGFTFSSYGMHWVRQAPGKGLEWVAVIWSDGSNKYYADSVKGRFTISRDNSKNTLYLQMNSLRAEDTAVYYCARNLPFDYWGQGTLVTVSS

SEQ ID NO: 163 - protein, 123 aa, Homo Sapiens
QVQLVESGGGVVQPGRSLRLSCAASGFTFSSYGMHWVRQAPGKGLEWVAVIWDDGSNQYYTDSVKGRFTVSRDNSKNTLFLQMNSLRAEDTAVYYCARSHYGGDYDYYGMDVWGQGTTVTVSS

SEQ ID NO: 164 - protein, 120 aa, Homo Sapiens
QVQLVESGGGVVQPGRSLRLSCAASGFTFSSYGMHWVRQAPGKGLEWVAVIWYDGSNKRYVDSVKGRFTISRDNSKNTLYLQMNSLRAEDTAVYYCARDGWQQQAPFDYWGQGTLVTVSS

SEQ ID NO: 165 - protein, 118 aa, Homo Sapiens
QVQLVESGGGVVQPGRSLRLSCAASGFTFRSHGMHWVRQAPGKGLEWVAVIWYDGSNKNYADSVRGRFTISRDNSKNTLDLQMNSLRAEDTAVYYCARWGISAPFDCWGQGTLVTVSS

SEQ ID NO: 166 - protein, 115 aa, Homo Sapiens
EVQLVESGGGLVQPGGSLRLSCAASGFTFSAYSMNWVRQAPGKGLEWVSYISSSGRTIYYADSVKGRFTISRDNAKNSLFLQMNSLRDEDTAVYYCALWAPFDYWGQGTLVTVSS

SEQ ID NO: 167 - protein, 125 aa, Homo Sapiens
EVQLVESGGGLVQPGGSLRLSCAASGFTFSSYSMNWVRQAPGKGLEWVSHISSSSRTIYYADSVKGRFTISRDNAKNSVYLQMNSLRDEDTAVYYCARDGYNWNGGGNYYGMDVWGQGTTVTVSS

SEQ ID NO: 168 - protein, 125 aa, Homo Sapiens
EVQLVESGGGLVQPGGSLRLSCAASGFTFSSYSMNWVRQAPGKGLEWVSHISRSSRTIYYADSVKGRFTISRDNAKNSLYLQMNSLRDEDTAVYYCARDGYNWNNGGYYYGMDVWGQGTTVTVSS

SEQ ID NO: 169 - protein, 118 aa, Homo Sapiens
QVQLQESGPGLVKPSQTLSLTCTVSGGSVSSGGYYWSWIRQHPGKGLEWIGYIHSSGSTYYNPSLKSRVTISVDTSKNQFSLNLSSVTAADTAVYYCARGPYYGMDVWGQGTTVTVSS

SEQ ID NO: 170 - protein, 127 aa, Homo Sapiens
QVQLQESGPGLVKPSQTLSLTCTVSGGSISRGGYYWSWIRQHPGKGLEWIGYIYHSGSTYYNPSLKSRVNMSVDTSKNQFSLKLSSVTAADTAVYYCARALRGIVLMVYVLGALDIWGQGTKVTVSS

SEQ ID NO: 171 - protein, 127 aa, Homo Sapiens
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARDETVVRGLIRYCYGMDVWGQGTTVTVSS

SEQ ID NO: 172 - protein, 122 aa, Homo Sapiens
QVQLQESGPGLVKPSQTLSLNCTVSGGSISSGGYYWSWIRQHPGKGLEWIGYIHYSGSTYYNPSLKSRITISADTSKNQFSLKLNSVTAADTAVYYCARDRGGGDYGRMDVWGQGTTVTVSS

SEQ ID NO: 173 - protein, 122 aa, Homo Sapiens; identical to SEQ ID NO: 172

SEQ ID NO: 174 - protein, 119 aa, Homo Sapiens
QVQLQESGPGLVKPSQTLSLTCTVSGGSISSGGYYWSWIRQHPGKGLEWIGYIHSSGSTYYNPSLKSRITKSVDTSKNQFSLKLSSVTAADTAVYYCARSNNYGCFALWGRGTLVTVSS

SEQ ID NO: 175 - protein, 119 aa, Homo Sapiens; identical to SEQ ID NO: 174

SEQ ID NO: 176 - protein, 133 aa, Homo Sapiens
QVQLQESGPGLVKPSQTLSLTCTVSGGSISSGGYYWSWIRQHPGKGLEWIGYIHYSGSTYYNPSLKSRVTISVDTSKNQFSLKLSSVTAADTAVYYCASGYNYGLYYYDSSGYPSYYYGMDVWGQGTTVTVSS

SEQ ID NO: 177 - protein, 125 aa, Homo Sapiens
QVQLQESGPGLVKPSQTLSLTCTVSGGSISSGDYYWNWVRQHPGKGLEWIGYIYYSGGTYYNPSLKSRVTISVDTSKNQFSLKLFSVTAADTAVYFCARTYYDILTGYPFYFDYWGQGTLVTVSS

SEQ ID NO: 178 - protein, 125 aa, Homo Sapiens; identical to SEQ ID NO: 177

SEQ ID NO: 179 - protein, 120 aa, Homo Sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGYSSSWYWFDPWGQGTLVTVSS

SEQ ID NO: 180 - protein, 120 aa, Homo Sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGYSSSWFWFDPWGQGTLVTVSS

SEQ ID NO: 181 - protein, 123 aa, Homo Sapiens
QVQLQESGPGLVKPSETLSLTCTVSGGSISSYYWSWIRQPAGKGLEWIGRIYTSGTTNYNPSLKSRVTMSVDTSKNQFSLKLSSVTAADTAVYYCARDGYSYGHYYYYGMDVWGQGTTVTVSS

SEQ ID NO: 182 - protein, 126 aa, Homo Sapiens
QVQLQESGPGLVKPSETLSLTCTVSGGSVSSGGSYWSWIRQPPGKGLEWIGYIYYSGSTNYNPSLKSRVTISIVTSRNQFSLKLSSVTAADTAVYYCARSALRYFDWLFSDVSDIWGQGTMVTVSS

SEQ ID NO: 183 - protein, 120 aa, Homo Sapiens
EVQLVQSGAELKKPGESLKISCKGSGYRFTSYWIGWVRQMPGKGLEWMGIIYPDDSDTRYSPSFQGQVTISADKSISTAYLQWSSLKASDTAMYYCARQKSYGYSYFDYWGQGTLVTVSS

SEQ ID NO: 184 - protein, 121 aa, Homo Sapiens
EVQLVQSGAEVKKPGESLKISCKGSGYSFTSYWIGWVRQMPGKGLEWMGIIYPDDSDARYSPSFQGQVTISADKSINTAYLQWSSLKASDTAMYYCARQGYGSGWGYFDYWGQGTLVTVSS

SEQ ID NO: 185 - protein, 127 aa, Homo Sapiens
EVQLVQSGAEVKKPGESLKISCKGSGYSFTSYWIGWVRQMPGKGLEWMGIIYPGDSDIRYSPSFQGQVTISADKSISTAYLQWSSLKASDTAMYYCARQGLAVAGTSYYYYYGMDVWGQGTTVTVSS

SEQ ID NO: 186 - protein, 125 aa, Homo Sapiens
QVQLQQSGPGLVKPSQTLSLTCAISGDSVSSYSAAWNWIRQSPSRGLEWLGRTYCRSKWYNDYAVSVKSRITINPDTSKNQFSLQLNSVTPEDTAVYYCARDRAVAGYYYGMDVWGQGTTVTVSS

SEQ ID NO: 187 - protein, 107 aa, Homo Sapiens [sequence omitted]

SEQ ID NO: 188 - protein, 326 aa, Homo Sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 189 - protein, 16 aa, Homo Sapiens
RSSQSLVYSDGNTYLN

SEQ ID NO: 190 - protein, 16 aa, Homo Sapiens
KSSQSLLHSDGKTYLY

SEQ ID NO: 191 - protein, 11 aa, Homo Sapiens
RASQGIANYLA

SEQ ID NO: 192 - protein, 11 aa, Homo Sapiens
RASQGISNDLA

SEQ ID NO: 193 - protein, 16 aa, Homo Sapiens
RSSQSLVHSDGNTYLS

SEQ ID NO: 194 - protein, 12 aa, Homo Sapiens
RASQTVISSYLA

SEQ ID NO: 195 - protein, 10 aa, Homo Sapiens
RASQSVSRLA

SEQ ID NO: 196 - protein, 11 aa, Homo Sapiens
RASQGIRNDLG

SEQ ID NO: 197 - protein, 17 aa, Homo Sapiens
KSSQSVLYSSNNKNYLV

SEQ ID NO: 198 - protein, 17 aa, Homo Sapiens
KSSQSVLYSSNNKNYLA

SEQ ID NO: 199 - protein, 17 aa, Homo Sapiens
KSSQNVLYSSNNKNYLA

SEQ ID NO: 200 - protein, 17 aa, Homo Sapiens
KSSQSVLYNSNNKNYLA

SEQ ID NO: 201 - protein, 17 aa, Homo Sapiens
KSSQSVLDSSNNKNYLA

SEQ ID NO: 202 - protein, 17 aa, Homo Sapiens
KSSQSILYRSNNKNYLA

SEQ ID NO: 203 - protein, 11 aa, Homo Sapiens
RASQDISHYLA

SEQ ID NO: 204 - protein, 11 aa, Homo Sapiens
RASQDISNYLA

SEQ ID NO: 205 - protein, 11 aa, Homo Sapiens
RASQSVSSNLA

SEQ ID NO: 206 - protein, 11 aa, Homo Sapiens
RASQDISRWLA

SEQ ID NO: 207 - protein, 11 aa, Homo Sapiens
RASQSISTYLN

SEQ ID NO: 208 - protein, 11 aa, Homo Sapiens
RASQTISIYLN

SEQ ID NO: 209 - protein, 11 aa, Homo Sapiens
RASQSIRSYLN

SEQ ID NO: 210 - protein, 11 aa, Homo Sapiens
RASQTISRYLN

SEQ ID NO: 211 - protein, 11 aa, Homo Sapiens
RASQRISSYLN

SEQ ID NO: 212 - protein, 11 aa, Homo Sapiens
RASQSISRYLN

SEQ ID NO: 213 - protein, 11 aa, Homo Sapiens
RASQSISSYLN

SEQ ID NO: 214 - protein, 11 aa, Homo Sapiens
QASQDISNYLN

SEQ ID NO: 215 - protein, 11 aa, Homo Sapiens
QASQDISNSLN

SEQ ID NO: 216 - protein, 11 aa, Homo Sapiens
QASQDISDYLN

SEQ ID NO: 217 - protein, 11 aa, Homo Sapiens
QASQDITNYLN

SEQ ID NO: 218 - protein, 7 aa, Homo Sapiens
KVSNWDS

SEQ ID NO: 219 - protein, 7 aa, Homo Sapiens
EVSNRFS

SEQ ID NO: 220 - protein, 7 aa, Homo Sapiens
VASTLQS

SEQ ID NO: 221 - protein, 7 aa, Homo Sapiens
AASTLQS

SEQ ID NO: 222 - protein, 7 aa, Homo Sapiens
KISNRFS

SEQ ID NO: 223 - protein, 7 aa, Homo Sapiens
GASSRAT

SEQ ID NO: 224 - protein, 7 aa, Homo Sapiens
GASRRAT

SEQ ID NO: 225 - protein, 7 aa, Homo Sapiens
AASSLQS

SEQ ID NO: 226 - protein, 7 aa, Homo Sapiens
WASTRES

SEQ ID NO: 227 - protein, 7 aa, Homo Sapiens
WASTRKS

SEQ ID NO: 228 - protein, 7 aa, Homo Sapiens
WASARES

SEQ ID NO: 229 - protein, 7 aa, Homo Sapiens
AESSLQS

SEQ ID NO: 230 - protein, 7 aa, Homo Sapiens
TASSLQS

SEQ ID NO: 231 - protein, 7 aa, Homo Sapiens
TVSSLQS

SEQ ID NO: 232 - protein, 7 aa, Homo Sapiens
DASNLET

SEQ ID NO: 233 - protein, 7 aa, Homo Sapiens
DASILET

SEQ ID NO: 234 - protein, 9 aa, Homo Sapiens
MQSTHWPIT

SEQ ID NO: 235 - protein, 9 aa, Homo Sapiens
IQGTHWPTT

SEQ ID NO: 236 - protein, 9 aa, Homo Sapiens
MQGTHWPIT

SEQ ID NO: 237 - protein, 9 aa, Homo Sapiens
MQGIQLPCS

SEQ ID NO: 238 - protein, 9 aa, Homo Sapiens
MQSIQLPLT

SEQ ID NO: 239 - protein, 9 aa, Homo Sapiens
MQSIQLPIT

SEQ ID NO: 240 - protein, 9 aa, Homo Sapiens
QNYNSAPFT

SEQ ID NO: 241 - protein, 9 aa, Homo Sapiens
QKYNSVPLT

SEQ ID NO: 242 - protein, 9 aa, Homo Sapiens
MQATQFPHT

SEQ ID NO: 243 - protein, 9 aa, Homo Sapiens
QQYGSSPRT

SEQ ID NO: 244 - protein, 9 aa, Homo Sapiens
QQYGSSPRS

SEQ ID NO: 245 - protein, 9 aa, Homo Sapiens
LQHNSYPPT

SEQ ID NO: 246 - protein, 9 aa, Homo Sapiens
QQYYSFPWT

SEQ ID NO: 247 - protein, 9 aa, Homo Sapiens
QQYYSTTWT

SEQ ID NO: 248 - protein, 9 aa, Homo Sapiens
QQYYGTPRT

SEQ ID NO: 249 - protein, 9 aa, Homo Sapiens
QQYYSISRT

SEQ ID NO: 250 - protein, 9 aa, Homo Sapiens
QQYYSTMFS

SEQ ID NO: 251 - protein, 9 aa, Homo Sapiens
HQYYSTPLT

SEQ ID NO: 252 - protein, 9 aa, Homo Sapiens
QQYFITPLT

SEQ ID NO: 253 - protein, 9 aa, Homo Sapiens
QQYNNYPFT

SEQ ID NO: 254 - protein, 9 aa, Homo Sapiens
QQYNTYPFT

SEQ ID NO: 255 - protein, 10 aa, Homo Sapiens
QQHNNWPPWT

SEQ ID NO: 256 - protein, 9 aa, Homo Sapiens
QQANSFPPT

SEQ ID NO: 257 - protein, 9 aa, Homo Sapiens
QQSHSAPFT

SEQ ID NO: 258 - protein, 8 aa, Homo Sapiens
QQSYSTLT

SEQ ID NO: 259 - protein, 9 aa, Homo Sapiens
QQSYSIPLT

SEQ ID NO: 260 - protein, 9 aa, Homo Sapiens
QQIYSTSIT

SEQ ID NO: 261 - protein, 9 aa, Homo Sapiens
QQSYITPIT

SEQ ID NO: 262 - protein, 9 aa, Homo Sapiens
QQSYFTPIT

SEQ ID NO: 263 - protein, 9 aa, Homo Sapiens
QQSYFSPIT

SEQ ID NO: 264 - protein, 9 aa, Homo Sapiens
QQSFYTPIT

SEQ ID NO: 265 - protein, 9 aa, Homo Sapiens
QQSFYAPIT

SEQ ID NO: 266 - protein, 9 aa, Homo Sapiens
QQYDYLPFT

SEQ ID NO: 267 - protein, 9 aa, Homo Sapiens
QQCDDLPLT

SEQ ID NO: 268 - protein, 9 aa, Homo Sapiens
QHYDNLPLT

SEQ ID NO: 269 - protein, 9 aa, Homo Sapiens
QQYDNLPLT

SEQ ID NO: 270 - protein, 9 aa, Homo Sapiens
QQCDILPLS

SEQ ID NO: 271 - protein, 9 aa, Homo Sapiens
QQYDNLPLA

SEQ ID NO: 272 - protein, 9 aa, Homo Sapiens
QQYDSLPIT

SEQ ID NO: 273 - protein, 9 aa, Homo Sapiens
QQYDNLPIT

SEQ ID NO: 274 - protein, 9 aa, Homo Sapiens
QHYDNLPIT

SEQ ID NO: 275 - protein, 10 aa, Homo Sapiens
GYTFTSYGIS

SEQ ID NO: 276 - protein, 10 aa, Homo Sapiens
GYTFTGHYMH

SEQ ID NO: 277 - protein, 10 aa, Homo Sapiens
GYTFTGYYMH

SEQ ID NO: 278 - protein, 10 aa, Homo Sapiens
GYTLTELSMH

SEQ ID NO: 279 - protein, 12 aa, Homo Sapiens
GFSLSNARMGVS

SEQ ID NO: 280 - protein, 12 aa, Homo Sapiens
GFSLSTGGVGVG

SEQ ID NO: 281 - protein, 12 aa, Homo Sapiens
GFSLNTGGVGVG

SEQ ID NO: 282 - protein, 10 aa, Homo Sapiens
GFPFSRYSMN

SEQ ID NO: 283 - protein, 10 aa, Homo Sapiens
GFTFSSYAMN

SEQ ID NO: 284 - protein, 10 aa, Homo Sapiens
GFTFSSYAMS

SEQ ID NO: 285 - protein, 10 aa, Homo Sapiens
GFTFSSYGMH

SEQ ID NO: 286 - protein, 10 aa, Homo Sapiens
GFTFSSYDMH

SEQ ID NO: 287 - protein, 10 aa, Homo Sapiens
GFTFRSHGMH

SEQ ID NO: 288 - protein, 10 aa, Homo Sapiens
GFTFSAYSMN

SEQ ID NO: 289 - protein, 10 aa, Homo Sapiens
GFTFSSYSMN

SEQ ID NO: 290 - protein, 12 aa, Homo Sapiens
GGSVSSGGYYWS

SEQ ID NO: 291 - protein, 12 aa, Homo Sapiens
GGSISRGGYYWS

SEQ ID NO: 292 - protein, 12 aa, Homo Sapiens
GGSISSGGYYWS

SEQ ID NO: 293 - protein, 12 aa, Homo Sapiens
GGSISSGDYYWN

SEQ ID NO: 294 - protein, 10 aa, Homo Sapiens
GGSFSGYYWS

SEQ ID NO: 295 - protein, 10 aa, Homo Sapiens
GGSISSYYWS

SEQ ID NO: 296 - protein, 12 aa, Homo Sapiens
GGSVSSGGSYWS

SEQ ID NO: 297 - protein, 10 aa, Homo Sapiens
GYRFTSYWIG

SEQ ID NO: 298 - protein, 10 aa, Homo Sapiens
GYSFTSYWIG

SEQ ID NO: 299 - protein, 12 aa, Homo Sapiens
GDSVSSYSAAWN

SEQ ID NO: 300 - protein, 17 aa, Homo Sapiens
WISASNGNTNYAQKLQD

SEQ ID NO: 301 - protein, 17 aa, Homo Sapiens
WINPNSGGTNCAQKFQG

SEQ ID NO: 302 - protein, 17 aa, Homo Sapiens
WINPNSGGTNHTQKFQG

SEQ ID NO: 303 - protein, 17 aa, Homo Sapiens
SFDPEDGETIYAQKFQG

SEQ ID NO: 304 - protein, 16 aa, Homo Sapiens
HIFSNDEKSYSTSLKS

SEQ ID NO: 305 - protein, 16 aa, Homo Sapiens
LIFSNDEKSYSTSLKS

SEQ ID NO: 306 - protein, 16 aa, Homo Sapiens
LIYWNDDKRYSPSLKS

SEQ ID NO: 307 - protein, 16 aa, Homo Sapiens
LIYWNVEKRYSPSLRS

SEQ ID NO: 308 - protein, 17 aa, Homo Sapiens
AISSSSSYIYYADSVKG

SEQ ID NO: 309 - protein, 17 aa, Homo Sapiens
AISGSGGSTYYADSVKG

SEQ ID NO: 310 - protein, 17 aa, Homo Sapiens
FISDDGSTKYYADSVKG

SEQ ID NO: 311 - protein, 17 aa, Homo Sapiens
VIWYDGSNKYYADSVKG

SEQ ID NO: 312 - protein, 17 aa, Homo Sapiens
VIWYDGSIKYYADSVKG

SEQ ID NO: 313 - protein, 17 aa, Homo Sapiens
VIWSDGSNKYYADSVKG

SEQ ID NO: 314 - protein, 17 aa, Homo Sapiens
VIWDDGSNQYYTDSVKG

SEQ ID NO: 315 - protein, 17 aa, Homo Sapiens
VIWYDGSNKRYVDSVKG

SEQ ID NO: 316 - protein, 17 aa, Homo Sapiens
VIWYDGSNKNYADSVRG

SEQ ID NO: 317 - protein, 17 aa, Homo Sapiens
YISSSGRTIYYADSVKG

SEQ ID NO: 318 - protein, 17 aa, Homo Sapiens
HISSSSRTIYYADSVKG

SEQ ID NO: 319 - protein, 17 aa, Homo Sapiens
HISRSSRTIYYADSVKG

SEQ ID NO: 320 - protein, 16 aa, Homo Sapiens
YIHSSGSTYYNPSLKS

SEQ ID NO: 321 - protein, 16 aa, Homo Sapiens
YIYHSGSTYYNPSLKS

SEQ ID NO: 322 - protein, 16 aa, Homo Sapiens
YIYYSGSTYYNPSLKS

SEQ ID NO: 323 - protein, 16 aa, Homo Sapiens
YIHYSGSTYYNPSLKS

SEQ ID NO: 324 - protein, 16 aa, Homo Sapiens
YIYYSGGTYYNPSLKS

SEQ ID NO: 325 - protein, 16 aa, Homo Sapiens
EINHSGSTNYNPSLKS

SEQ ID NO: 326 - protein, 16 aa, Homo Sapiens
RIYTSGTTNYNPSLKS

SEQ ID NO: 327 - protein, 16 aa, Homo Sapiens
YIYYSGSTNYNPSLKS

SEQ ID NO: 328 - protein, 17 aa, Homo Sapiens
IIYPDDSDTRYSPSFQG

SEQ ID NO: 329 - protein, 17 aa, Homo Sapiens
IIYPDDSDARYSPSFQG

SEQ ID NO: 330 - protein, 17 aa, Homo Sapiens
IIYPGDSDIRYSPSFQG

SEQ ID NO: 331 - protein, 18 aa, Homo Sapiens
RTYCRSKWYNDYAVSVKS

SEQ ID NO: 332 - protein, 11 aa, Homo Sapiens
EDNWNYGFFDY

SEQ ID NO: 333 - protein, 8 aa, Homo Sapiens
SIAVALDY

SEQ ID NO: 334 - protein, 13 aa, Homo Sapiens
EGDGGYYYYGMDV

SEQ ID NO: 335 - protein, 12 aa, Homo Sapiens
MYSSGWYGVFDY

SEQ ID NO: 336 - protein, 13 aa, Homo Sapiens
VYSSGWSFYGMDV

SEQ ID NO: 337 - protein, 8 aa, Homo Sapiens
RRELPFDY

SEQ ID NO: 338 - protein, 8 aa, Homo Sapiens
RNWTPFDY

SEQ ID NO: 339 - protein, 8 aa, Homo Sapiens
RLELPFDY

SEQ ID NO: 340 - protein, 8 aa, Homo Sapiens
RREVPFDY

SEQ ID NO: 341 - protein, 8 aa, Homo Sapiens
RHTNPFEY

SEQ ID NO: 342 - protein, 8 aa, Homo Sapiens
RGELPFDY

SEQ ID NO: 343 - protein, 12 aa, Homo Sapiens
DRVGATPDAFDI

SEQ ID NO: 344 - protein, 19 aa, Homo Sapiens
EGIAVAGTAEYYYYYAMDV

SEQ ID NO: 345 - protein, 16 aa, Homo Sapiens
EGIAARDSYYYYAMDV

SEQ ID NO: 346 - protein, 16 aa, Homo Sapiens
EGIAGRDSYYYYGMDV

SEQ ID NO: 347 - protein, 14 aa, Homo Sapiens
SYYDSSGYYYGFDY

SEQ ID NO: 348 - protein, 5 aa, Homo Sapiens
NVIDY

SEQ ID NO: 349 - protein, 11 aa, Homo Sapiens
GGATGAEYFQH

SEQ ID NO: 350 - protein, 9 aa, Homo Sapiens
LWFGETFDY

SEQ ID NO: 351 - protein, 6 aa, Homo Sapiens
NLPFDY

SEQ ID NO: 352 - protein, 14 aa, Homo Sapiens
SHYGGDYDYYGMDV

SEQ ID NO: 353 - protein, 11 aa, Homo Sapiens
DGWQQQAPFDY

SEQ ID NO: 354 - protein, 9 aa, Homo Sapiens
WGISAPFDC

SEQ ID NO: 355 - protein, 6 aa, Homo Sapiens
WAPFDY

SEQ ID NO: 356 - protein, 16 aa, Homo Sapiens
DGYNWNGGGNYYGMDV

SEQ ID NO: 357 - protein, 16 aa, Homo Sapiens
DGYNWNNGGYYYGMDV

SEQ ID NO: 358 - protein, 8 aa, Homo Sapiens
GPYYGMDV

SEQ ID NO: 359 - protein, 17 aa, Homo Sapiens
ALRGIVLMVYVLGALDI

SEQ ID NO: 360 - protein, 17 aa, Homo Sapiens
DETVVRGLIRYCYGMDV

SEQ ID NO: 361 - protein, 12 aa, Homo Sapiens
DRGGGDYGRMDV

SEQ ID NO: 362 - protein, 9 aa, Homo Sapiens
SNNYGCFAL

SEQ ID NO: 363 - protein, 23 aa, Homo Sapiens
GYNYGLYYYDSSGYPSYYYGMDV

SEQ ID NO: 364 - protein, 15 aa, Homo Sapiens
TYYDILTGYPFYFDY

SEQ ID NO: 365 - protein, 12 aa, Homo Sapiens
GGYSSSWYWFDP

SEQ ID NO: 366 - protein, 12 aa, Homo Sapiens
GGYSSSWFWFDP

SEQ ID NO: 367 - protein, 15 aa, Homo Sapiens
DGYSYGHYYYYGMDV

SEQ ID NO: 368 - protein, 16 aa, Homo Sapiens
SALRYFDWLFSDVSDI

SEQ ID NO: 369 - protein, 11 aa, Homo Sapiens
QKSYGYSYFDY

SEQ ID NO: 370 - protein, 12 aa, Homo Sapiens
QGYGSGWGYFDY

SEQ ID NO: 371 - protein, 18 aa, Homo Sapiens
QGLAVAGTSYYYYYGMDV

SEQ ID NO: 372 - protein, 13 aa, Homo Sapiens
DRAVAGYYYGMDV

SEQ ID NO: 373 - protein, 23 aa, Homo Sapiens
DVVMTQSPLSLPVTLGQPASISC

SEQ ID NO: 374 - protein, 23 aa, Homo Sapiens
DVVMTQSPLSLPVTLGQPASISC

SEQ ID NO: 375 - protein, 23 aa, Homo Sapiens
DIVMTQTPLSLSVTPGQPASISC

SEQ ID NO: 376 - protein, 23 aa, Homo Sapiens
DIVMTQTPLSLSVTPGQPASISC

SEQ ID NO: 377 - protein, 23 aa, Homo Sapiens
DIQMTQSPSSLSASVGDRVTIIC

SEQ ID NO: 378 - protein, 23 aa, Homo Sapiens
EIVMTQTPLSSPVTLGQPASISC

SEQ ID NO: 379 - protein, 23 aa, Homo Sapiens
EIVLTQSPGTLSLSPGERATLSC

SEQ ID NO: 380 - protein, 23 aa, Homo Sapiens
EIVLTQSPGTLSLSPGERATLSC

SEQ ID NO: 381 - protein, 23 aa, Homo Sapiens
DIQMTQSPSSLSASVGDRVTITC

SEQ ID NO: 382 - protein, 23 aa, Homo Sapiens
DIVMTQSPDSLAVSLGERATINC

SEQ ID NO: 383 - protein, 23 aa, Homo Sapiens
DIVMTQSPDSLAVSLGERATINC

SEQ ID NO: 384 - protein, 23 aa, Homo Sapiens
DIVMTQSPDSLAVSLGERATINC

SEQ ID NO: 385 - protein, 23 aa, Homo Sapiens
DIQMTQSPSSLSASVGDRVTITC

SEQ ID NO: 386 - protein, 23 aa, Homo Sapiens
DIQMTQSPSSLSASVGDRVAITC

SEQ ID NO: 387 - protein, 23 aa, Homo Sapiens
EIVMTQSPATLSVSPGERATLSC

SEQ ID NO: 388 - protein, 23 aa, Homo Sapiens
DIQMTQSPSSLSASLGDRVTITC

SEQ ID NO: 389 - protein, 23 aa, Homo Sapiens
DIQMTQSPSSLSASVGDRVTITC

SEQ ID NO: 390 - protein, 23 aa, Homo Sapiens
DIQMTQSPSSLSASVGDRVTITC

SEQ ID NO: 391 - protein, 23 aa, Homo Sapiens
DIQMTQSPSSLSASVGDRVTITC

SEQ ID NO: 392 - protein, 23 aa, Homo Sapiens
DIQMTQSPSSLSASVGDRVTITC

SEQ ID NO: 393 - protein, 23 aa, Homo Sapiens
DIQMTQSPSSLSASVGDRVTITC

SEQ ID NO: 394 - protein, 15 aa, Homo Sapiens
WLQQRPGQSPRRLIY

SEQ ID NO: 395 - protein, 15 aa, Homo Sapiens
WYLQKPGQPPQLLIY

SEQ ID NO: 396 - protein, 15 aa, Homo Sapiens
WFLQKPGQPPQPLIY

SEQ ID NO: 397 - protein, 15 aa, Homo Sapiens
WYQQKPGKVPKLLIY

SEQ ID NO: 398 - protein, 15 aa, Homo Sapiens
WLQQRPGQPPRLLIY

SEQ ID NO: 399 - protein, 15 aa, Homo Sapiens
WYQQKPGQAPRLLIS

SEQ ID NO: 400 - protein, 15 aa, Homo Sapiens
WYQQKPGQAPRLLIY

SEQ ID NO: 401 - protein, 15 aa, Homo Sapiens
WYQQKPGKAPKRLIY

SEQ ID NO: 402 - protein, 15 aa, Homo Sapiens
WYQQKPGQPPKLFIY

SEQ ID NO: 403 - protein, 15 aa, Homo Sapiens
WYQQKPGQPPKLLIY

SEQ ID NO: 404 - protein, 15 aa, Homo Sapiens
WYQQKPGQPPKVLIY

SEQ ID NO: 405 - protein, 15 aa, Homo Sapiens
WFQQKPGKAPKSLIY

SEQ ID NO: 406 - protein, 15 aa, Homo Sapiens
WLQQKPGKAPKSLIY

SEQ ID NO: 407 - protein, 15 aa, Homo Sapiens
WYQQDPGQAPRLLIY

SEQ ID NO: 408 - protein, 15 aa, Homo Sapiens
WYQQKPGKAPKLLIY

SEQ ID NO: 409 - protein, 15 aa, Homo Sapiens
WYQQKPGKAPKFLIY

SEQ ID NO: 410 - protein, 15 aa, Homo Sapiens
WYQQRPGNAPKLLIY

SEQ ID NO: 411 - protein, 15 aa, Homo Sapiens
WYQQKPGKAPKVLIY

SEQ ID NO: 412 - protein, 15 aa, Homo Sapiens
WYQQKPGKAPELLIY

SEQ ID NO: 413 - protein, 15 aa, Homo Sapiens
WYQQKLGKAPKLLIH

SEQ ID NO: 414 - protein, 32 aa, Homo Sapiens
GVPDRFNGSGSGTDFTLKISRVEAEDVGVYYC

SEQ ID NO: 415 - protein, 32 aa, Homo Sapiens
GVPDRFSGSGSGTDFTLKISRVEAEDVGVYYC

SEQ ID NO: 416 - protein, 32 aa, Homo Sapiens
GVPSRFSGSGSGTDFTLTISSLQPEDVATYYC

SEQ ID NO: 417 - protein, 32 aa, Homo Sapiens
GVPDRFSGSGAGTDFTLKISRVEAEDVGVYYC

SEQ ID NO: 418 - protein, 32 aa, Homo Sapiens
GVPDRFSGTGAGTDFTLKISRVEAEDVGVYYC

SEQ ID NO: 419 - protein, 32 aa, Homo Sapiens
GIPDRFSGSGSGTDFTLTISRLEPEDFAVYYC

SEQ ID NO: 420 - protein, 32 aa, Homo Sapiens
GVPSRFSGSGSGTEFTLTISSLQPEDFATYYC

SEQ ID NO: 421 - protein, 32 aa, Homo Sapiens
GVPDRFTGSGSGTDFTLTISSLQAEDVAVYYC

SEQ ID NO: 422 - protein, 32 aa, Homo Sapiens
GVPDRFSGSGSGTDFTLTISSLQAEDVAVYYC

SEQ ID NO: 423 - protein, 32 aa, Homo Sapiens
GVPDRFSGSGSGTDFTLTISSLQAEDVAVYFC

SEQ ID NO: 424 - protein, 32 aa, Homo Sapiens
GVPDRFGGSGSGTDFTLTISSLQAEDVAVYYC

SEQ ID NO: 425 - protein, 32 aa, Homo Sapiens
GVPDRFSGSGSGTDFTLTISSLQADDVAVYYC

SEQ ID NO: 426 - protein, 32 aa, Homo Sapiens
GVPDRFSGSGSGTDFTLTISGLQAEDVALYYC

SEQ ID NO: 427 - protein, 32 aa, Homo Sapiens
GVPDRFSGSGSGTDFTLTISSLQAEDVAVFYC

SEQ ID NO: 428 - protein, 32 aa, Homo Sapiens
GVPSKFSGSGSGTDFTLTISSLQPEDFATYYC

SEQ ID NO: 429 - protein, 32 aa, Homo Sapiens
GVPSRFSGSGSGTDFTLTISSLQPEDFATYYC

SEQ ID NO: 430 - protein, 32 aa, Homo Sapiens
GIPARFSGSGSGTEFTLTISSLQSEDFAVYYC

SEQ ID NO: 431 - protein, 32 aa, Homo Sapiens
GVPSRFSGSGSGTDFTLTISSLQPEDFAAYYC

SEQ ID NO: 432 - protein, 32 aa, Homo Sapiens
GVPSRVSGSGSGTDFTLTIRSLQPEDFATYYC

SEQ ID NO: 433 - protein, 32 aa, Homo Sapiens
GVPSRFSGSGSGTDFTLTLSSLQPEDFATYYC

SEQ ID NO: 434 - protein, 32 aa, Homo Sapiens
GVPSRFSGSGSGTDFTLTISSLQPENFATYYC

SEQ ID NO: 435 - protein, 32 aa, Homo Sapiens
GVPSRFSGSGSGTDFTLTFSSLQPEDFATYYC

SEQ ID NO: 436 - protein, 32 aa, Homo Sapiens
GVPSRFSGSGSGTDFTLTLSSLQPEDFASYYC

SEQ ID NO: 437 - protein, 32 aa, Homo Sapiens
GVPSRFSGSGSGTDFTLTISSLQPEDFASYYC

SEQ ID NO: 438 - protein, 32 aa, Homo Sapiens
GVPSRFSGSGSGTDFTFTISSLQPEDIATYYC

SEQ ID NO: 439 - protein, 32 aa, Homo Sapiens
GVPSRFSGSGSETDFTFTISSLQPEDIATYYC

SEQ ID NO: 440 - protein, 10 aa, Homo Sapiens
FGQGTRLEIK

SEQ ID NO: 441 - protein, 10 aa, Homo Sapiens
FGQGTRLEII

SEQ ID NO: 442 - protein, 10 aa, Homo Sapiens
FGQGTKLEIK

SEQ ID NO: 443 - protein, 10 aa, Homo Sapiens
FGGGTKVEIK

SEQ ID NO: 444 - protein, 10 aa, Homo Sapiens
FGHGTRLEIK

SEQ ID NO: 445 - protein, 10 aa, Homo Sapiens
FGPGTKVDIK

SEQ ID NO: 446 - protein, 10 aa, Homo Sapiens
FGQGTKVEIK

SEQ ID NO: 447 - protein, 10 aa, Homo Sapiens
FGPGTKVEIK

SEQ ID NO: 448 - protein, 10 aa, Homo Sapiens
FGGGTKVAIK

SEQ ID NO: 449 - protein, 10 aa, Homo Sapiens
FGPGTKMDIK

SEQ ID NO: 450 - protein, 10 aa, Homo Sapiens
FGQGTKVEFK

SEQ ID NO: 451 - protein, 10 aa, Homo Sapiens
FGGGTKVEIR

SEQ ID NO: 452 - protein, 25 aa, Homo Sapiens [sequence omitted]

SEQ ID NO: 453 - protein, 25 aa, Homo Sapiens
QVHLVQSGAEVKKPGASVKVSCKVS

SEQ ID NO: 454 - protein, 25 aa, Homo Sapiens
QVQLVQSGAEVRKPGASVKVSCKVS

SEQ ID NO: 455 - protein, 25 aa, Homo Sapiens
QVTLKESGPVLVKPTETLTLTCTVS

SEQ ID NO: 456 - protein, 25 aa, Homo Sapiens
QITLKESGPTLVKPTQTLTLTCTFS

SEQ ID NO: 457 - protein, 25 aa, Homo Sapiens
EVQLVESGGGLVKPGGSLRLSCAAS

SEQ ID NO: 458 - protein, 25 aa, Homo Sapiens
EVQLLESGGGLVQPGGSLRLSCAAS

SEQ ID NO: 459 - protein, 25 aa, Homo Sapiens
EVQLLESGGGLVQPGGSLRLSCTAS

SEQ ID NO: 460 - protein, 25 aa, Homo Sapiens
QVQLVESGGGVVQPGRSLRLSCAAS

SEQ ID NO: 461 - protein, 25 aa, Homo Sapiens [sequence omitted]

SEQ ID NO: 462 - protein, 25 aa, Homo Sapiens
QVQLQESGPGLVKPSQTLSLTCTVS

SEQ ID NO: 463 - protein, 25 aa, Homo Sapiens
QVQLQESGPGLVKPSQTLSLNCTVS

SEQ ID NO: 464 - protein, 25 aa, Homo Sapiens [sequence omitted]

SEQ ID NO: 465 - protein, 25 aa, Homo Sapiens
QVQLQESGPGLVKPSETLSLTCTVS

SEQ ID NO: 466 - protein, 25 aa, Homo Sapiens
EVQLVQSGAELKKPGESLKISCKGS

SEQ ID NO: 467 - protein, 25 aa, Homo Sapiens
EVQLVQSGAEVKKPGESLKISCKGS

SEQ ID NO: 468 - protein, 25 aa, Homo Sapiens
QVQLQQSGPGLVKPSQTLSLTCAIS

SEQ ID NO: 469 - protein, 14 aa, Homo Sapiens
WVRQAPGQGLEWMG

SEQ ID NO: 470 - protein, 14 aa, Homo Sapiens
WVRQAPGKGLEWMG

SEQ ID NO: 471 - protein, 14 aa, Homo Sapiens
WIRQPPGKALEWLA

SEQ ID NO: 472 - protein, 14 aa, Homo Sapiens
WIRQPPGKALEWLV

SEQ ID NO: 473 - protein, 14 aa, Homo Sapiens
WVRQAPGKGLEWVS

SEQ ID NO: 474 - protein, 14 aa, Homo Sapiens
WVRQAPGKGLEWVA

SEQ ID NO: 475 - protein, 14 aa, Homo Sapiens
WIRQHPGKGLEWIG

SEQ ID NO: 476 - protein, 14 aa, Homo Sapiens
WVRQHPGKGLEWIG

SEQ ID NO: 477 - protein, 14 aa, Homo Sapiens
WIRQPPGKGLEWIG

SEQ ID NO: 478 - protein, 14 aa, Homo Sapiens
WIRQPAGKGLEWIG

SEQ ID NO: 479 - protein, 14 aa, Homo Sapiens
WVRQMPGKGLEWMG

SEQ ID NO: 480 - protein, 14 aa, Homo Sapiens
WIRQSPSRGLEWLG

SEQ ID NO: 481 - protein, 32 aa, Homo Sapiens
RVTMTTDTSTSTAYMELRSLRSDDTAVYYCAR

SEQ ID NO: 482 - protein, 32 aa, Homo Sapiens
RVTMTRDTSISTAYMELSRLRSDDTAVYYCAR

SEQ ID NO: 483 - protein, 32 aa, Homo Sapiens
RVTMLEDTSTDTAYMELSSLRSEDTAVYYCAT

SEQ ID NO: 484 - protein, 32 aa, Homo Sapiens
RLTISKDTSKSQVVLTMTNMDPVDTATYYCAR

SEQ ID NO: 485 - protein, 32 aa, Homo Sapiens
RLTITKDTSKNQVVLTMTNMDPVDTATYYCAH

SEQ ID NO: 486 - protein, 32 aa, Homo Sapiens
RLTITKDTSKTQVVLTVTDMDPVDTATYYCAH

SEQ ID NO: 487 - protein, 32 aa, Homo Sapiens
RLTITKDTSKNQVVLTMTNLDPVDTATYYCAH

SEQ ID NO: 488 - protein, 32 aa, Homo Sapiens
RLTITKATSKNQVVLTMTNMDPVDTATYYCAH

SEQ ID NO: 489 - protein, 32 aa, Homo Sapiens
RFTISRDNAKNSLYLQMNSLRAEDTAVYYCAR

SEQ ID NO: 490 - protein, 32 aa, Homo Sapiens
RFTISRDNSKNTLYLQMNSLRAEDTAVYYCAK

SEQ ID NO: 491 - protein, 32 aa, Homo Sapiens
RFTISRDNSKNTLYLQMNSLRAEDTAEYYCAK

SEQ ID NO: 492 - protein, 32 aa, Homo Sapiens
RFTISRDNSMNTLYLQMNSLRAEDTAVYYCAR

SEQ ID NO: 493 - protein, 32 aa, Homo Sapiens
RFTISRDNSKNTLYLQMNSLRAEDTAVYYCAR

SEQ ID NO: 494 - protein, 32 aa, Homo Sapiens
RFTISRDNSKNTLYLQMNSLRAEDTAVYYCVL

SEQ ID NO: 495 - protein, 32 aa, Homo Sapiens
RFTISRDNSKNTLDLQMNSLRAEDTAVYYCAR

SEQ ID NO: 496 - protein, 32 aa, Homo Sapiens
RFTISRDNAKNSLFLQMNSLRDEDTAVYYCAL

SEQ ID NO: 497 - protein, 32 aa, Homo Sapiens
RFTISRDNAKNSVYLQMNSLRDEDTAVYYCAR

SEQ ID NO: 498 - protein, 32 aa, Homo Sapiens
RFTISRDNAKNSLYLQMNSLRDEDTAVYYCAR

SEQ ID NO: 499 - protein, 32 aa, Homo Sapiens
RVTISVDTSKNQFSLNLSSVTAADTAVYYCAR

SEQ ID NO: 500 - protein, 32 aa, Homo Sapiens
RVNMSVDTSKNQFSLKLSSVTAADTAVYYCAR

SEQ ID NO: 501 - protein, 32 aa, Homo Sapiens
RVTISVDTSKNQFSLKLSSVTAADTAVYYCAR

SEQ ID NO: 502 - protein, 32 aa, Homo Sapiens
RITISADTSKNQFSLKLNSVTAADTAVYYCAR

SEQ ID NO: 503 - protein, 32 aa, Homo Sapiens
RITKSVDTSKNQFSLKLSSVTAADTAVYYCAR

SEQ ID NO: 504 - protein, 32 aa, Homo Sapiens
RVTISVDTSKNQFSLKLSSVTAADTAVYYCAS

SEQ ID NO: 505 - protein, 32 aa, Homo Sapiens
RVTISVDTSKNQFSLKLFSVTAADTAVYFCAR

SEQ ID NO: 506 - protein, 32 aa, Homo Sapiens
RVTMSVDTSKNQFSLKLSSVTAADTAVYYCAR

SEQ ID NO: 507 - protein, 32 aa, Homo Sapiens
RVTISIVTSRNQFSLKLSSVTAADTAVYYCAR

SEQ ID NO: 508 - protein, 32 aa, Homo Sapiens
QVTISADKSISTAYLQWSSLKASDTAMYYCAR

SEQ ID NO: 509 - protein, 32 aa, Homo Sapiens
QVTISADKSINTAYLQWSSLKASDTAMYYCAR

SEQ ID NO: 510 - protein, 32 aa, Homo Sapiens
RITINPDTSKNQFSLQLNSVTPEDTAVYYCAR

SEQ ID NO: 511 - protein, 11 aa, Homo Sapiens
WGQGTLVTVSS

SEQ ID NO: 512 - protein, 11 aa, Homo Sapiens
WGQGTTVTVSS

SEQ ID NO: 513 - protein, 11 aa, Homo Sapiens
WGQGTMVTVSS

SEQ ID NO: 514 - protein, 11 aa, Homo Sapiens
WGQGSLVTVSP

SEQ ID NO: 515 - protein, 11 aa, Homo Sapiens
WGQGTKVTVSS

SEQ ID NO: 516 - protein, 11 aa, Homo Sapiens
WGRGTLVTVSS

SEQ ID NO: 517 - protein, 657 aa, Homo Sapiens
GAYGTNGTNATGACNCARWSNCCNMTNWSNMTNCCNGTNACNMTNGGNCARCCNGCNWSNATHWSNTGYMGNWSNWSNCARWSNMTNGTNTAYWSNGAYGGNAAYACNTAYMTNAAYTGGTTYCARCARMGNCCNGGNCARWSNCCNMGNMGNMTNATHTAYAARGTNWSNAAYTGGGAYWSNGGNGTNCCNGAYMGNTTYAAYGGNWSNGGNWSNGGNACNGAYTTYACNMTNAARATHWSNMGNGTNGARGCNGARGAYGTNGGNGTNTAYTAYTGYATGCARWSNACNCAYTGGCCNATHACNTTYGGNCARGGNACNMGNMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 518 - protein, 657 aa, Homo Sapiens
GAYGTNGTNATGACNCARWSNCCNMTNWSNMTNCCNGTNACNMTNGGNCARCCNGCNWSNATHWSNTGYMGNWSNWSNCARWSNMTNGTNTAYWSNGAYGGNAAYACNTAYMTNAAYTGGTTYCARCARMGNCCNGGNCARWSNCCNMGNMGNMTNATHTAYAARGTNWSNAAYTGGGAYWSNGGNGTNCCNGAYMGNTTYWSNGGNWSNGGNWSNGGNACNGAYTTYACNMTNAARATHWSNMGNGTNGARGCNGARGAYGTNGGNGTNTAYTAYTGYATHCARGGNACNCAYTGGCCNACNACNTTYGGNCARGGNACNMGNMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 519 - protein, 657 aa, Homo Sapiens
GAYGTNGTNATGACNCARWSNCCNMTNWSNMTNCCNGTNACNMTNGGNCARCCNGCNWSNATHWSNTGYMGNWSNWSNCARWSNMTNGTNTAYWSNGAYGGNAAYACNTAYMTNAAYTGGMTNCARCARMGNCCNGGNCARWSNCCNMGNMGNMTNATHTAYAARGTNWSNAAYTGGGAYWSNGGNGTNCCNGAYMGNTTYWSNGGNWSNGGNWSNGGNACNGAYTTYACNMTNAARATHWSNMGNGTNGARGCNGARGAYGTNGGNGTNTAYTAYTGYATGCARGGNACNCAYTGGCCNATHACNTTYGGNCARGGNACNMGNMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 520 - protein, 657 aa, Homo Sapiens
GAYATHGTNATGACNCARACNCCNMTNWSNMTNWSNGTNACNCCNGGNCARCCNGCNWSNATHWSNTGYAARWSNWSNCARWSNMTNMTNCAYWSNGAYGGNAARACNTAYMTNTAYTGGTAYMTNCARAARCCNGGNCARCCNCCNCARMTNMTNATHTAYGARGTNWSNAAYMGNTTYWSNGGNGTNCCNGAYMGNTTYWSNGGNWSNGGNWSNGGNACNGAYTTYACNMTNAARATHWSNMGNGTNGARGCNGARGAYGTNGGNGTNTAYTAYTGYATGCARGGNATHCARMTNCCNTGYWSNTTYGGNCARGGNACNAARMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 521 - protein, 657 aa, Homo Sapiens
GAYATHGTNATGACNCARACNCCNMTNWSNMTNWSNGTNACNCCNGGNCARCCNGCNWSNATHWSNTGYAARWSNWSNCARWSNMTNMTNCAYWSNGAYGGNAARACNTAYMTNTAYTGGTAYMTNCARAARCCNGGNCARCCNCCNCARMTNMTNATHTAYGARGTNWSNAAYMGNTTYWSNGGNGTNCCNGAYMGNTTYWSNGGNWSNGGNWSNGGNACNGAYTTYACNMTNAARATHWSNMGNGTNGARGCNGARGAYGTNGGNGTNTAYTAYTGYATGCARWSNATHCARMTNCCNMTNACNTTYGGNGGNGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 522 - protein, 657 aa, Homo Sapiens
GAYATHGTNATGACNCARACNCCNMTNWSNMTNWSNGTNACNCCNGGNCARCCNGCNWSNATHWSNTGYAARWSNWSNCARWSNMTNMTNCAYWSNGAYGGNAARACNTAYMTNTAYTGGTTYMTNCARAARCCNGGNCARCCNCCNCARCCNMTNATHTAYGARGTNWSNAAYMGNTTYWSNGGNGTNCCNGAYMGNTTYWSNGGNWSNGGNWSNGGNACNGAYTTYACNMTNAARATHWSNMGNGTNGARGCNGARGAYGTNGGNGTNTAYTAYTGYATGCARWSNATHCARMTNCCNATHACNTTYGGNCAYGGNACNMGNMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 523 - protein, 642 aa, Homo Sapiens
GAYATHCARATGACNCARWSNCCNWSNWSNMTNWSNGCNWSNGTNGGNGAYMGNGTNACNATHACNTGYMGNGCNWSNCARGGNATHGCNAAYTAYMTNGCNTGGTAYCARCARAARCCNGGNAARGTNCCNAARMTNMTNATHTAYGTNGCNWSNACNMTNCARWSNGGNGTNCCNWSNMGNTTYWSNGGNWSNGGNWSNGGNACNGAYTTYACNMTNACNATHWSNWSNMTNCARCCNGARGAYGTNGCNACNTAYTAYTGYCARAAYTAYAAYWSNGCNCCNTTYACNTTYGGNCCNGGNACNAARGTNGAYATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 524 - protein, 642 aa, Homo Sapiens
GAYATHCARATGACNCARWSNCCNWSNWSNMTNWSNGCNWSNGTNGGNGAYMGNGTNACNATHATHTGYMGNGCNWSNCARGGNATHWSNAAYGAYMTNGCNTGGTAYCARCARAARCCNGGNAARGTNCCNAARMTNMTNATHTAYGCNGCNWSNACNMTNCARWSNGGNGTNCCNWSNMGNTTYWSNGGNWSNGGNWSNGGNACNGAYTTYACNMTNACNATHWSNWSNMTNCARCCNGARGAYGTNGCNACNTAYTAYTGYCARAARTAYAAYWSNGTNCCNMTNACNTTYGGNGGNGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 525 - protein, 657 aa, Homo Sapiens
AAYATHGTNATGACNCARACNCCNMTNWSNWSNCCNGTNACNMTNGGNCARCCNGCNWSNATHWSNTGYMGNWSNWSNCARWSNMTNGTNCAYWSNGAYGGNAAYACNTAYMTNWSNTGGMTNCARCARMGNCCNGGNCARCCNCCNMGNMTNMTNATHTAYAARATHWSNAAYMGNTTYWSNGGNGTNCCNGAYMGNTTYWSNGGNWSNGGNGCNGGNACNGAYTTYACNMTNAARATHWSNMGNGTNGARGCNGARGAYGTNGGNGTNTAYTAYTGYATGCARGCNACNCARTTYCCNCAYACNTTYGGNCCNGGNACNAARGTNGAYATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 526 - protein, 657 aa, Homo Sapiens
GARATHGTNATGACNCARACNCCNMTNWSNWSNCCNGTNACNMTNGGNCARCCNGCNWSNATHWSNTGYMGNWSNWSNCARWSNMTNGTNCAYWSNGAYGGNAAYACNTAYMTNWSNTGGMTNCARCARMGNCCNGGNCARCCNCCNMGNMTNMTNATHTAYAARATHWSNAAYMGNTTYWSNGGNGTNCCNGAYMGNTTYWSNGGNACNGGNGCNGGNACNGAYTTYACNMTNAARATHWSNMGNGTNGARGCNGARGAYGTNGGNGTNTAYTAYTGYATGCARGCNACNCARTTYCCNCAYACNTTYGGNGGNGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 527 - protein, 645 aa, Homo Sapiens
GARATHGTNMTNACNCARWSNCCNGGNACNMTNWSNMTNWSNCCNGGNGARMGNGCNACNMTNWSNTGYMGNGCNWSNCARACNGTNATHWSNWSNTAYMTNGCNTGGTAYCARCARAARCCNGGNCARGCNCCNMGNMTNMTNATHWSNGGNGCNWSNWSNMGNGCNACNGGNATHCCNGAYMGNTTYWSNGGNWSNGGNWSNGGNACNGAYTTYACNMTNACNATHWSNMGNMTNGARCCNGARGAYTTYGCNGTNTAYTAYTGYCARCARTAYGGNWSNWSNCCNMGNACNTTYGGNCARGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 528 - protein, 639 aa, Homo Sapiens
GARATHGTNMTNACNCARWSNCCNGGNACNMTNWSNMTNWSNCCNGGNGARMGNGCNACNMTNWSNTGYMGNGCNWSNCARWSNGTNWSNMGNMTNGCNTGGTAYCARCARAARCCNGGNCARGCNCCNMGNMTNMTNATHTAYGGNGCNWSNMGNMGNGCNACNGGNATHCCNGAYMGNTTYWSNGGNWSNGGNWSNGGNACNGAYTTYACNMTNACNATHWSNMGNMTNGARCCNGARGAYTTYGCNGTNTAYTAYTGYCARCARTAYGGNWSNWSNCCNMGNWSNTTYGGNCARGGNACNAARMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 529 - protein, 642 aa, Homo Sapiens
GAYATHCARATGACNCARWSNCCNWSNWSNMTNWSNGCNWSNGTNGGNGAYMGNGTNACNATHACNTGYMGNGCNWSNCARGGNATHMGNAAYGAYMTNGGNTGGTAYCARCARAARCCNGGNAARGCNCCNAARMGNMTNATHTAYGCNGCNWSNWSNMTNCARWSNGGNGTNCCNWSNMGNTTYWSNGGNWSNGGNWSNGGNACNGARTTYACNMTNACNATHWSNWSNMTNCARCCNGARGAYTTYGCNACNTAYTAYTGYMTNCARCAYAAYWSNTAYCCNCCNACNTTYGGNCARGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 530 - protein, 660 aa, Homo Sapiens
GAYATHGTNATGACNCARWSNCCNGAYWSNMTNGCNGTNWSNMTNGGNGARMGNGCNACNATHAAYTGYAARWSNWSNCARWSNGTNMTNTAYWSNWSNAAYAAYAARAAYTAYMTNGTNTGGTAYCARCARAARCCNGGNCARCCNCCNAARMTNTTYATHTAYTGGGCNWSNACNMGNGARWSNGGNGTNCCNGAYMGNTTYACNGGNWSNGGNWSNGGNACNGAYTTYACNMTNACNATHWSNWSNMTNCARGCNGARGAYGTNGCNGTNTAYTAYTGYCARCARTAYTAYWSNTTYCCNTGGACNTTYGGNCARGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 531 - protein, 660 aa, Homo Sapiens
GAYATHGTNATGACNCARWSNCCNGAYWSNMTNGCNGTNWSNMTNGGNGARMGNGCNACNATHAAYTGYAARWSNWSNCARWSNGTNMTNTAYWSNWSNAAYAAYAARAAYTAYMTNGCNTGGTAYCARCARAARCCNGGNCARCCNCCNAARMTNMTNATHTAYTGGGCNWSNACNMGNGARWSNGGNGTNCCNGAYMGNTTYWSNGGNWSNGGNWSNGGNACNGAYTTYACNMTNACNATHWSNWSNMTNCARGCNGARGAYGTNGCNGTNTAYTAYTGYCARCARTAYTAYWSNACNACNTGGACNTTYGGNCARGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 532 - protein, 660 aa, Homo Sapiens
GAYATHGTNATGACNCARWSNCCNGAYWSNMTNGCNGTNWSNMTNGGNGARMGNGCNACNATHAAYTGYAARWSNWSNCARAAYGTNMTNTAYWSNWSNAAYAAYAARAAYTAYMTNGCNTGGTAYCARCARAARCCNGGNCARCCNCCNAARMTNMTNATHTAYTGGGCNWSNACNMGNGARWSNGGNGTNCCNGAYMGNTTYWSNGGNWSNGGNWSNGGNACNGAYTTYACNMTNACNATHWSNWSNMTNCARGCNGARGAYGTNGCNGTNTAYTTYTGYCARCARTAYTAYGGNACNCCNMGNACNTTYGGNCARGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 533 - protein, 660 aa, Homo Sapiens; identical to SEQ ID NO: 532

SEQ ID NO: 534 - protein, 660 aa, Homo Sapiens
GAYATHGTNATGACNCARWSNCCNGAYWSNMTNACNGTNWSNMTNGGNGARMGNGCNACNATHAAYTGYAARWSNWSNCARWSNGTNMTNTAYWSNWSNAAYAAYAARAAYTAYMTNGCNTGGTAYCARCARAARCCNGGNCARCCNCCNAARMTNMTNATHTAYTGGGCNWSNACNMGNGARWSNGGNGTNCCNGAYMGNTTYGGNGGNWSNGGNWSNGGNACNGAYTTYACNMTNACNATHWSNWSNMTNCARGCNGARGAYGTNGCNGTNTAYTAYTGYCARCARTAYTAYWSNATHWSNMGNACNTTYGGNCARGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 535 - protein, 660 aa, Homo Sapiens
GAYATHGTNATGACNCARWSNCCNGAYWSNMTNGCNGTNWSNMTNGGNGARMGNGCNACNATHAAYTGYAARWSNWSNCARWSNGTNMTNTAYAAYWSNAAYAAYAARAAYTAYMTNGCNTGGTAYCARCARAARCCNGGNCARCCNCCNAARMTNMTNATHTAYTGGGCNWSNACNMGNGARWSNGGNGTNCCNGAYMGNTTYWSNGGNWSNGGNWSNGGNACNGAYTTYACNMTNACNATHWSNWSNMTNCARGCNGAYGAYGTNGCNGTNTAYTAYTGYCARCARTAYTAYWSNACNACNTGGACNTTYGGNCCNGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 536 - protein, 660 aa, Homo Sapiens; identical to SEQ ID NO: 535

SEQ ID NO: 537 - protein, 660 aa, Homo Sapiens
GAYATHGTNATGACNCARWSNCCNGAYWSNMTNGCNGTNWSNMTNGGNGARMGNGCNACNATHAAYTGYAARWSNWSNCARWSNGTNMTNTAYWSNWSNAAYAAYAARAAYTAYMTNGCNTGGTAYCARCARAARCCNGGNCARCCNCCNAARGTNMTNATHTAYTGGGCNWSNACNMGNAARWSNGGNGTNCCNGAYMGNTTYWSNGGNWSNGGNWSNGGNACNGAYTTYACNMTNACNATHWSNGGNMTNCARGCNGARGAYGTNGCNMTNTAYTAYTGYCARCARTAYTAYWSNACNATGTTYWSNTTYGGNCARGGNACNAARMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 538 - protein, 660 aa, Homo Sapiens
GAYATHGTNATGACNCARWSNCCNGAYWSNMTNGCNGTNWSNMTNGGNGARMGNGCNACNATHAAYTGYAARWSNWSNCARWSNGTNMTNGAYWSNWSNAAYAAYAARAAYTAYMTNGCNTGGTAYCARCARAARCCNGGNCARCCNCCNAARMTNMTNATHTAYTGGGCNWSNACNMGNGARWSNGGNGTNCCNGAYMGNTTYWSNGGNWSNGGNWSNGGNACNGAYTTYACNMTNACNATHWSNWSNMTNCARGCNGARGAYGTNGCNGTNTTYTAYTGYCAYCARTAYTAYWSNACNCCNMTNACNTTYGGNGGNGGNACNAARGTNGCNATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 539 - protein, 660 aa, Homo Sapiens
GAYATHGTNATGACNCARWSNCCNGAYWSNMTNGCNGTNWSNMTNGGNGARMGNGCNACNATHAAYTGYAARWSNWSNCARWSNATHMTNTAYMGNWSNAAYAAYAARAAYTAYMTNGCNTGGTAYCARCARAARCCNGGNCARCCNCCNAARMTNMTNATHTAYTGGGCNWSNGCNMGNGARWSNGGNGTNCCNGAYMGNTTYWSNGGNWSNGGNWSNGGNACNGAYTTYACNMTNACNATHWSNWSNMTNCARGCNGARGAYGTNGCNGTNTAYTTYTGYCARCARTAYTTYATHACNCCNMTNACNTTYGGNGGNGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 540 - protein, 642 aa, Homo Sapiens
GAYATHCARATGACNCARWSNCCNWSNWSNMTNWSNGCNWSNGTNGGNGAYMGNGTNACNATHACNTGYMGNGCNWSNCARGAYATHWSNCAYTAYMTNGCNTGGTTYCARCARAARCCNGGNAARGCNCCNAARWSNMTNATHTAYGCNGCNWSNWSNMTNCARWSNGGNGTNCCNWSNAARTTYWSNGGNWSNGGNWSNGGNACNGAYTTYACNMTNACNATHWSNWSNMTNCARCCNGARGAYTTYGCNACNTAYTAYTGYCARCARTAYAAYAAYTAYCCNTTYACNTTYGGNCCNGGNACNAARGTNGAYATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 541 - protein, 642 aa, Homo Sapiens
GAYATHCARATGACNCARWSNCCNWSNWSNMTNWSNGCNWSNGTNGGNGAYMGNGTNGCNATHACNTGYMGNGCNWSNCARGAYATHWSNAAYTAYMTNGCNTGGMTNCARCARAARCCNGGNAARGCNCCNAARWSNMTNATHTAYGCNGCNWSNWSNMTNCARWSNGGNGTNCCNWSNMGNTTYWSNGGNWSNGGNWSNGGNACNGAYTTYACNMTNACNATHWSNWSNMTNCARCCNGARGAYTTYGCNACNTAYTAYTGYCARCARTAYAAYACNTAYCCNTTYACNTTYGGNCCNGGNACNAARATGGAYATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 542 - protein, 645 aa, Homo Sapiens
GARATHGTNATGACNCARWSNCCNGCNACNMTNWSNGTNWSNCCNGGNGARMGNGCNACNMTNWSNTGYMGNGCNWSNCARWSNGTNWSNWSNAAYMTNGCNTGGTAYCARCARGAYCCNGGNCARGCNCCNMGNMTNMTNATHTAYGGNGCNWSNMGNMGNGCNACNGGNATHCCNGCNMGNTTYWSNGGNWSNGGNWSNGGNACNGARTTYACNMTNACNATHWSNWSNMTNCARWSNGARGAYTTYGCNGTNTAYTAYTGYCARCARCAYAAYAAYTGGCCNCCNTGGACNTTYGGNCARGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 543 - protein, 642 aa, Homo Sapiens
GAYATHCARATGACNCARWSNCCNWSNWSNGTNWSNGCNWSNGTNGGNGAYMGNGTNACNATHACNTGYMGNGCNWSNCARGAYATHWSNMGNTGGMTNGCNTGGTAYCARCARAARCCNGGNAARGCNCCNAARMTNMTNATHTAYGCNGCNWSNWSNMTNCARWSNGGNGTNCCNWSNMGNTTYWSNGGNWSNGGNWSNGGNACNGAYTTYACNMTNACNATHWSNWSNMTNCARCCNGARGAYTTYGCNACNTAYTAYTGYCARCARGCNAAYWSNTTYCCNCCNACNTTYGGNCARGGNACNAARGTNGARTTYAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 544 - protein, 642 aa, Homo Sapiens
GAYATHCARATGACNCARWSNCCNWSNWSNMTNWSNGCNWSNGTNGGNGAYMGNGTNACNATHACNTGYMGNGCNWSNCARWSNATHWSNACNTAYMTNAAYTGGTAYCARCARAARCCNGGNAARGCNCCNAARTTYMTNATHTAYGCNGCNWSNWSNMTNCARWSNGGNGTNCCNWSNMGNTTYWSNGGNWSNGGNWSNGGNACNGAYTTYACNMTNACNATHWSNWSNMTNCARCCNGARGAYTTYGCNGCNTAYTAYTGYCARCARWSNCAYWSNGCNCCNTTYACNTTYGGNCCNGGNACNAARGTNGAYATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 545 - protein, 639 aa, Homo Sapiens
GAYATHCARATGACNCARWSNCCNWSNWSNMTNWSNGCNWSNMTNGGNGAYMGNGTNACNATHACNTGYMGNGCNWSNCARACNATHWSNATHTAYMTNAAYTGGTAYCARCARAARCCNGGNAARGCNCCNAARMTNMTNATHTAYGCNGCNWSNWSNMTNCARWSNGGNGTNCCNWSNMGNTTYWSNGGNWSNGGNWSNGGNACNGAYTTYACNMTNACNATHWSNWSNMTNCARCCNGARGAYTTYGCNACNTAYTAYTGYCARCARWSNTAYWSNACNMTNACNTTYGGNGGNGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 546 - protein, 642 aa, Homo Sapiens
GAYATHCARATGACNCARWSNCCNWSNWSNMTNWSNGCNWSNGTNGGNGAYMGNGTNACNATHACNTGYMGNGCNWSNCARWSNATHMGNWSNTAYMTNAAYTGGTAYCARCARMGNCCNGGNAAYGCNCCNAARMTNMTNATHTAYGCNGCNWSNWSNMTNCARWSNGGNGTNCCNWSNMGNGTNWSNGGNWSNGGNWSNGGNACNGAYTTYACNMTNACNATHMGNWSNMTNCARCCNGARGAYTTYGCNACNTAYTAYTGYCARCARWSNTAYWSNATHCCNMTNACNTTYGGNGGNGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 547 - protein, 642 aa, Homo Sapiens
GAYATHCARATGACNCARWSNCCNWSNWSNMGNWSNGCNWSNGTNGGNGAYMGNGTNACNATHACNTGYMGNGCNWSNCARACNATHWSNMGNTAYMTNAAYTGGTAYCARCARAARCCNGGNAARGCNCCNAARMTNMTNATHTAYGCNGCNWSNACNMTNCARWSNGGNGTNCCNWSNMGNTTYWSNGGNWSNGGNWSNGGNACNGAYTTYACNMTNACNMTNWSNWSNMTNCARCCNGARGAYTTYGCNACNTAYTAYTGYCARCARATHTAYWSNACNWSNATHACNTTYGGNCARGGNACNMGNMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 548 - protein, 642 aa, Homo Sapiens
GAYATHCARATGACNCARWSNCCNWSNWSNMTNWSNGCNWSNGTNGGNGAYMGNGTNACNATHACNTGYMGNGCNWSNCARMGNATHWSNWSNTAYMTNAAYTGGTAYCARCARAARCCNGGNAARGCNCCNAARGTNMTNATHTAYGCNGARWSNWSNMTNCARWSNGGNGTNCCNWSNMGNTTYWSNGGNWSNGGNWSNGGNACNGAYTTYACNMTNACNATHWSNWSNMTNCARCCNGARGAYTTYGCNACNTAYTAYTGYCARCARWSNTAYATHACNCCNATHACNTTYGGNCARGGNACNMGNMTNGARATHATHMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 549 - protein, 642 aa, Homo Sapiens
GAYATHCARATGACNCARWSNCCNWSNWSNMTNWSNGCNWSNGTNGGNGAYMGNGTNACNATHACNTGYMGNGCNWSNCARWSNATHWSNMGNTAYMTNAAYTGGTAYCARCARAARCCNGGNAARGCNCCNAARMTNMTNATHTAYACNGCNWSNWSNMTNCARWSNGGNGTNCCNWSNMGNTTYWSNGGNWSNGGNWSNGGNACNGAYTTYACNMTNACNATHWSNWSNMTNCARCCNGARAAYTTYGCNACNTAYTAYTGYCARCARWSNTAYTTYACNCCNATHACNTTYGGNCARGGNACNMGNMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 550 - protein, 642 aa, Homo Sapiens
GAYATHCARATGACNCARWSNCCNWSNWSNMTNWSNGCNWSNGTNGGNGAYMGNGTNACNATHACNTGYMGNGCNWSNCARWSNATHWSNWSNTAYMTNAAYTGGTAYCARCARAARCCNGGNAARGCNCCNAARMTNMTNATHTAYACNGCNWSNWSNMTNCARWSNGGNGTNCCNWSNMGNTTYWSNGGNWSNGGNWSNGGNACNGAYTTYACNMTNACNTTYWSNWSNMTNCARCCNGARGAYTTYGCNACNTAYTAYTGYCARCARWSNTAYTTYWSNCCNATHACNTTYGGNCARGGNACNMGNMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 551 - protein, 642 aa, Homo Sapiens
GAYATHCARATGACNCARWSNCCNWSNWSNMTNWSNGCNWSNGTNGGNGAYMGNGTNACNATHACNTGYMGNGCNWSNCARWSNATHWSNWSNTAYMTNAAYTGGTAYCARCARAARCCNGGNAARGCNCCNAARMTNMTNATHTAYACNGCNWSNWSNMTNCARWSNGGNGTNCCNWSNMGNTTYWSNGGNWSNGGNWSNGGNACNGAYTTYACNMTNACNMTNWSNWSNMTNCARCCNGARGAYTTYGCNWSNTAYTAYTGYCARCARWSNTTYTAYACNCCNATHACNTTYGGNCARGGNACNMGNMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 552 - protein, 642 aa, Homo Sapiens
GAYATHCARATGACNCARWSNCCNWSNWSNMTNWSNGCNWSNGTNGGNGAYMGNGTNACNATHACNTGYMGNGCNWSNCARWSNATHWSNWSNTAYMTNAAYTGGTAYCARCARAARCCNGGNAARGCNCCNAARMTNMTNATHTAYACNGTNWSNWSNMTNCARWSNGGNGTNCCNWSNMGNTTYWSNGGNWSNGGNWSNGGNACNGAYTTYACNMTNACNATHWSNWSNMTNCARCCNGARGAYTTYGCNACNTAYTAYTGYCARCARWSNTAYTTYACNCCNATHACNTTYGGNCARGGNACNMGNMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 553 - protein, 642 aa, Homo Sapiens
GAYATHCARATGACNCARWSNCCNWSNWSNMTNWSNGCNWSNGTNGGNGAYMGNGTNACNATHACNTGYMGNGCNWSNCARWSNATHWSNWSNTAYMTNAAYTGGTAYCARCARAARCCNGGNAARGCNCCNAARMTNMTNATHTAYACNGCNWSNWSNMTNCARWSNGGNGTNCCNWSNMGNTTYWSNGGNWSNGGNWSNGGNACNGAYTTYACNMTNACNATHWSNWSNMTNCARCCNGARGAYTTYGCNWSNTAYTAYTGYCARCARWSNTTYTAYGCNCCNATHACNTTYGGNCARGGNACNMGNMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 554 - protein, 642 aa, Homo Sapiens
GAYATHCARATGACNCARWSNCCNWSNWSNMTNWSNGCNWSNGTNGGNGAYMGNGTNACNATHACNTGYMGNGCNWSNCARWSNATHWSNWSNTAYMTNAAYTGGTAYCARCARAARCCNGGNAARGCNCCNAARMTNMTNATHTAYACNGCNWSNWSNMTNCARWSNGGNGTNCCNWSNMGNTTYWSNGGNWSNGGNWSNGGNACNGAYTTYACNMTNACNATHWSNWSNMTNCARCCNGARGAYTTYGCNACNTAYTAYTGYCARCARWSNTAYTTYACNCCNATHACNTTYGGNCARGGNACNMGNMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 555 - protein, 642 aa, Homo Sapiens
GAYATHCARATGACNCARWSNCCNWSNWSNMTNWSNGCNWSNGTNGGNGAYMGNGTNACNATHACNTGYCARGCNWSNCARGAYATHWSNAAYTAYMTNAAYTGGTAYCARCARAARCCNGGNAARGCNCCNAARMTNMTNATHTAYGAYGCNWSNAAYMTNGARACNGGNGTNCCNWSNMGNTTYWSNGGNWSNGGNWSNGGNACNGAYTTYACNTTYACNATHWSNWSNMTNCARCCNGARGAYATHGCNACNTAYTAYTGYCARCARTAYGAYTAYMTNCCNTTYACNTTYGGNCCNGGNACNAARGTNGAYATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 556 - protein, 642 aa, Homo Sapiens
GAYATHCARATGACNCARWSNCCNWSNWSNMTNWSNGCNWSNGTNGGNGAYMGNGTNACNATHACNTGYCARGCNWSNCARGAYATHWSNAAYWSNMTNAAYTGGTAYCARCARAARCCNGGNAARGCNCCNGARMTNMTNATHTAYGAYGCNWSNAAYMTNGARACNGGNGTNCCNWSNMGNTTYWSNGGNWSNGGNWSNGGNACNGAYTTYACNTTYACNATHWSNWSNMTNCARCCNGARGAYATHGCNACNTAYTAYTGYCARCARTGYGAYGAYMTNCCNMTNACNTTYGGNGGNGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 557 - protein, 642 aa, Homo Sapiens
GAYATHCARATGACNCARWSNCCNWSNWSNMTNWSNGCNWSNGTNGGNGAYMGNGTNACNATHACNTGYCARGCNWSNCARGAYATHWSNGAYTAYMTNAAYTGGTAYCARCARAARCCNGGNAARGCNCCNAARMTNMTNATHTAYGAYGCNWSNAAYMTNGARACNGGNGTNCCNWSNMGNTTYWSNGGNWSNGGNWSNGGNACNGAYTTYACNTTYACNATHWSNWSNMTNCARCCNGARGAYATHGCNACNTAYTAYTGYCARCAYTAYGAYAAYMTNCCNMTNACNTTYGGNGGNGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 558 - protein, 642 aa, Homo Sapiens
GAYATHCARATGACNCARWSNCCNWSNWSNMTNWSNGCNWSNGTNGGNGAYMGNGTNGCNATHACNTGYCARGCNWSNCARGAYATHWSNAAYTAYMTNAAYTGGTAYCARCARAARCCNGGNAARGCNCCNAARMTNMTNATHTAYGAYGCNWSNAAYMTNGARACNGGNGTNCCNWSNMGNTTYWSNGGNWSNGGNWSNGGNACNGAYTTYACNTTYACNATHWSNWSNMTNCARCCNGARGAYATHGCNACNTAYTAYTGYCARCARTAYGAYAAYMTNCCNMTNACNTTYGGNGGNGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 559 - protein, 642 aa, Homo Sapiens
GAYATHCARATGACNCARWSNCCNWSNWSNMTNWSNGCNWSNGTNGGNGAYMGNGTNACNATHACNTGYCARGCNWSNCARGAYATHWSNAAYWSNMTNAAYTGGTAYCARCARAARCCNGGNAARGCNCCNAARMTNMTNATHTAYGAYGCNWSNATHMTNGARACNGGNGTNCCNWSNMGNTTYWSNGGNWSNGGNWSNGARACNGAYTTYACNTTYACNATHWSNWSNMTNCARCCNGARGAYATHGCNACNTAYTAYTGYCARCARTGYGAYATHMTNCCNMTNWSNTTYGGNGGNGGNACNAARGTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 560 - protein, 642 aa, Homo Sapiens
GAYATHCARATGACNCARWSNCCNWSNWSNMTNWSNGCNWSNGTNGGNGAYMGNGTNACNATHACNTGYCARGCNWSNCARGAYATHWSNAAYWSNMTNAAYTGGTAYCARCARAARCCNGGNAARGCNCCNAARMTNMTNATHTAYGAYGCNWSNAAYMTNGARACNGGNGTNCCNWSNMGNTTYWSNGGNWSNGGNWSNGGNACNGAYTTYACNTTYACNATHWSNWSNMTNCARCCNGARGAYATHGCNACNTAYTAYTGYCARCARTAYGAYAAYMTNCCNMTNGCNTTYGGNGGNGGNACNAARGTNGARATHMGNMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 561 - protein, 642 aa, Homo Sapiens
GAYATHCARATGACNCARWSNCCNWSNWSNMTNWSNGCNWSNGTNGGNGAYGGNGTNACNATHACNTGYCARGCNWSNCARGAYATHACNAAYTAYMTNAAYTGGTAYCARCARAARCCNGGNAARGCNCCNAARMTNMTNATHTAYGAYGCNWSNAAYMTNGARACNGGNGTNCCNWSNMGNTTYWSNGGNWSNGGNWSNGGNACNGAYTTYACNTTYACNATHWSNWSNMTNCARCCNGARGAYATHGCNACNTAYTAYTGYCARCARTAYGAYWSNMTNCCNATHACNTTYGGNCARGGNACNMGNMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 562 - protein, 642 aa, Homo Sapiens
GAYATHCARATGACNCARWSNCCNWSNWSNMTNWSNGCNWSNGTNGGNGAYMGNGTNACNATHACNTGYCARGCNWSNCARGAYATHWSNAAYTAYMTNAAYTGGTAYCARCARAARMTNGGNAARGCNCCNAARMTNMTNATHCAYGAYGCNWSNAAYMTNGARACNGGNGTNCCNWSNMGNTTYWSNGGNWSNGGNWSNGGNACNGAYTTYACNTTYACNATHWSNWSNMTNCARCCNGARGAYATHGCNACNTAYTAYTGYCARCARTAYGAYAAYMTNCCNATHACNTTYGGNCARGGNACNMGNMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 563 - protein, 642 aa, Homo Sapiens
GAYATHCARATGACNCARWSNCCNWSNWSNMTNWSNGCNWSNGTNGGNGAYMGNGTNACNATHACNTGYCARGCNWSNCARGAYATHWSNGAYTAYMTNAAYTGGTAYCARCARAARCCNGGNAARGCNCCNAARMTNMTNATHTAYGAYGCNWSNAAYMTNGARACNGGNGTNCCNWSNMGNTTYWSNGGNWSNGGNWSNGGNACNGAYTTYACNTTYACNATHWSNWSNMTNCARCCNGARGAYATHGCNACNTAYTAYTGYCARCAYTAYGAYAAYMTNCCNATHACNTTYGGNCARGGNACNMGNMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 564 - protein, 642 aa, Homo Sapiens
GAYATHCARATGACNCARWSNCCNWSNWSNMTNWSNGCNWSNGTNGGNGAYMGNGTNACNATHACNTGYCARGCNWSNCARGAYATHWSNAAYWSNMTNAAYTGGTAYCARCARAARCCNGGNAARGCNCCNAARMTNMTNATHTAYGAYGCNWSNAAYMTNGARACNGGNGTNCCNWSNMGNTTYWSNGGNWSNGGNWSNGGNACNGAYTTYACNTTYACNATHWSNWSNMTNCARCCNGARGAYATHGCNACNTAYTAYTGYCARCAYTAYGAYAAYMTNCCNATHACNTTYGGNCARGGNACNMGNMTNGARATHAARMGNACNGTNGCNGCNCCNWSNGTNTTYATHTTYCCNCCNWSNGAYGARCARMTNAARWSNGGNACNGCNWSNGTNGTNTGYMTNMTNAAYAAYTTYTAYCCNMGNGARGCNAARGTNCARTGGAARGTNGAYAAYGCNMTNCARWSNGGNAAYWSNCARGARWSNGTNACNGARCARGAYWSNAARGAYWSNACNTAYWSNMTNWSNWSNACNMTNACNMTNWSNAARGCNGAYTAYGARAARCAYAARGTNTAYGCNTGYGARGTNACNCAYCARGGNMTNWSNWSNCCNGTNACNAARWSNTTYAAYMGNGGNGARTGY

SEQ ID NO: 565 - protein, 1338 aa, Homo Sapiens
CARGTNCARMTNGTNCARWSNGGNGCNGARGTNAARAARCCNGGNGCNWSNGTNAARGTNWSNTGYAARGCNWSNGGNTAYACNTTYACNWSNTAYGGNATHWSNTGGGTNMGNCARGCNCCNGGNCARGGNMTNGARTGGATGGGNTGGATHWSNGCNWSNAAYGGNAAYACNAAYTAYGCNCARAARMTNCARGAYMGNGTNACNATGACNACNGAYACNWSNACNWSNACNGCNTAYATGGARMTNMGNWSNMTNMGNWSNGAYGAYACNGCNGTNTAYTAYTGYGCNMGNGARGAYAAYTGGAAYTAYGGNTTYTTYGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 566 - protein, 1329 aa, Homo Sapiens
CARGTNCAYMTNGTNCARWSNGGNGCNGARGTNAARAARCCNGGNGCNWSNGTNAARGTNWSNTGYAARGTNWSNGGNTAYACNTTYACNGGNCAYTAYATGCAYTGGGTNMGNCARGCNCCNGGNCARGGNMTNGARTGGATGGGNTGGATHAAYCCNAAYWSNGGNGGNACNAAYTGYGCNCARAARTTYCARGGNMGNGTNACNATGACNMGNGAYACNWSNATHWSNACNGCNTAYATGGARMTNWSNMGNMTNMGNWSNGAYGAYACNGCNGTNTAYTAYTGYGCNMGNWSNATHGCNGTNGCNMTNGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 567 - protein, 1329 aa, Homo Sapiens
CARGTNCARMTNGTNCARWSNGGNGCNGARGTNAARAARCCNGGNGCNWSNGTNAARGTNWSNTGYAARGCNWSNGGNTAYACNTTYACNGGNTAYTAYATGCAYTGGGTNMGNCARGCNCCNGGNCARGGNMTNGARTGGATGGGNTGGATHAAYCCNAAYWSNGGNGGNACNAAYCAYACNCARAARTTYCARGGNMGNGTNACNATGACNMGNGAYACNWSNATHWSNACNGCNTAYATGGARMTNWSNMGNMTNMGNWSNGAYGAYACNGCNGTNTAYTAYTGYGCNMGNWSNATHGCNGTNGCNMTNGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 568 - protein, 1344 aa, Homo Sapiens
CARGTNCARMTNGTNCARWSNGGNGCNGARGTNMGNAARCCNGGNGCNWSNGTNAARGTNWSNTGYAARGTNWSNGGNTAYACNMTNACNGARMTNWSNATGCAYTGGGTNMGNCARGCNCCNGGNAARGGNMTNGARTGGATGGGNWSNTTYGAYCCNGARGAYGGNGARACNATHTAYGCNCARAARTTYCARGGNMGNGTNACNATGMTNGARGAYACNWSNACNGAYACNGCNTAYATGGARMTNWSNWSNMTNMGNWSNGARGAYACNGCNGTNTAYTAYTGYGCNACNGARGGNGAYGGNGGNTAYTAYTAYTAYGGNATGGAYGTNTGGGGNCARGGNACNACNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 569 - protein, 1344 aa, Homo Sapiens
CARGTNACNMTNAARGARWSNGGNCCNGTNMTNGTNAARCCNACNGARACNMTNACNMTNACNTGYACNGTNWSNGGNTTYWSNMTNWSNAAYGCNMGNATGGGNGTNWSNTGGATHMGNCARCCNCCNGGNAARGCNMTNGARTGGMTNGCNCAYATHTTYWSNAAYGAYGARAARWSNTAYWSNACNWSNMTNAARWSNMGNMTNACNATHWSNAARGAYACNWSNAARWSNCARGTNGTNMTNACNATGACNAAYATGGAYCCNGTNGAYACNGCNACNTAYTAYTGYGCNMGNATGTAYWSNWSNGGNTGGTAYGGNGTNTTYGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 570 - protein, 1347 aa, Homo Sapiens
CARGTNACNMTNAARGARWSNGGNCCNGTNMTNGTNAARCCNACNGARACNMTNACNMTNACNTGYACNGTNWSNGGNTTYWSNMTNWSNAAYGCNMGNATGGGNGTNWSNTGGATHMGNCARCCNCCNGGNAARGCNMTNGARTGGMTNGTNMTNATHTTYWSNAAYGAYGARAARWSNTAYWSNACNWSNMTNAARWSNMGNMTNACNATHWSNAARGAYACNWSNAARWSNCARGTNGTNMTNACNATGACNAAYATGGAYCCNGTNGAYACNGCNACNTAYTAYTGYGCNMGNGTNTAYWSNWSNGGNTGGWSNTTYTAYGGNATGGAYGTNTGGGGNCARGGNACNACNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 571 - protein, 1332 aa, Homo Sapiens
CARATHACNMTNAARGARWSNGGNCCNACNMTNGTNAARCCNACNCARACNMTNACNMTNACNTGYACNTTYWSNGGNTTYWSNMTNWSNACNGGNGGNGTNGGNGTNGGNTGGATHMGNCARCCNCCNGGNAARGCNMTNGARTGGMTNGCNMTNATHTAYTGGAAYGAYGAYAARMGNTAYWSNCCNWSNMTNAARWSNMGNMTNACNATHACNAARGAYACNWSNAARAAYCARGTNGTNMTNACNATGACNAAYATGGAYCCNGTNGAYACNGCNACNTAYTAYTGYGCNCAYMGNMGNGARMTNCCNTTYGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 572 - protein, 1332 aa, Homo Sapiens
CARATHACNMTNAARGARWSNGGNCCNACNMTNGTNAARCCNACNCARACNMTNACNMTNACNTGYACNTTYWSNGGNTTYWSNMTNWSNACNGGNGGNGTNGGNGTNGGNTGGATHMGNCARCCNCCNGGNAARGCNMTNGARTGGMTNGCNMTNATHTAYTGGAAYGAYGAYAARMGNTAYWSNCCNWSNMTNAARWSNMGNMTNACNATHACNAARGAYACNWSNAARACNCARGTNGTNMTNACNGTNACNGAYATGGAYCCNGTNGAYACNGCNACNTAYTAYTGYGCNCAYMGNAAYTGGACNCCNTTYGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 573 - protein, 1332 aa, Homo Sapiens
CARATHACNMTNAARGARWSNGGNCCNACNMTNGTNAARCCNACNCARACNMTNACNMTNACNTGYACNTTYWSNGGNTTYWSNMTNAAYACNGGNGGNGTNGGNGTNGGNTGGATHMGNCARCCNCCNGGNAARGCNMTNGARTGGMTNGCNMTNATHTAYTGGAAYGAYGAYAARMGNTAYWSNCCNWSNMTNAARWSNMGNMTNACNATHACNAARGAYACNWSNAARAAYCARGTNGTNMTNACNATGACNAAYATGGAYCCNGTNGAYACNGCNACNTAYTAYTGYGCNCAYMGNMTNGARMTNCCNTTYGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 574 - protein, 1332 aa, Homo Sapiens
CARATHACNMTNAARGARWSNGGNCCNACNMTNGTNAARCCNACNCARACNMTNACNMTNACNTGYACNTTYWSNGGNTTYWSNMTNWSNACNGGNGGNGTNGGNGTNGGNTGGATHMGNCARCCNCCNGGNAARGCNMTNGARTGGMTNGCNMTNATHTAYTGGAAYGAYGAYAARMGNTAYWSNCCNWSNMTNAARWSNMGNMTNACNATHACNAARGAYACNWSNAARAAYCARGTNGTNMTNACNATGACNAAYMTNGAYCCNGTNGAYACNGCNACNTAYTAYTGYGCNCAYMGNMGNGARGTNCCNTTYGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 575 - protein, 1332 aa, Homo Sapiens
CARATHACNMTNAARGARWSNGGNCCNACNMTNGTNAARCCNACNCARACNMTNACNMTNACNTGYACNTTYWSNGGNTTYWSNMTNWSNACNGGNGGNGTNGGNGTNGGNTGGATHMGNCARCCNCCNGGNAARGCNMTNGARTGGMTNGCNMTNATHTAYTGGAAYGTNGARAARMGNTAYWSNCCNWSNMTNMGNWSNMGNMTNACNATHACNAARGCNACNWSNAARAAYCARGTNGTNMTNACNATGACNAAYATGGAYCCNGTNGAYACNGCNACNTAYTAYTGYGCNCAYMGNCAYACNAAYCCNTTYGARTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 576 - protein, 1332 aa, Homo Sapiens
CARATHACNMTNAARGARWSNGGNCCNACNMTNGTNAARCCNACNCARACNMTNACNMTNACNTGYACNTTYWSNGGNTTYWSNMTNWSNACNGGNGGNGTNGGNGTNGGNTGGATHMGNCARCCNCCNGGNAARGCNMTNGARTGGMTNGCNMTNATHTAYTGGAAYGAYGAYAARMGNTAYWSNCCNWSNMTNAARWSNMGNMTNACNATHACNAARGAYACNWSNAARAAYCARGTNGTNMTNACNATGACNAAYATGGAYCCNGTNGAYACNGCNACNTAYTAYTGYGCNCAYMGNGGNGARMTNCCNTTYGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 577 - protein, 1341 aa, Homo Sapiens
GARGTNCARMTNGTNGARWSNGGNGGNGGNMTNGTNAARCCNGGNGGNWSNMTNMGNMTNWSNTGYGCNGCNWSNGGNTTYCCNTTYWSNMGNTAYWSNATGAAYTGGGTNMGNCARGCNCCNGGNAARGGNMTNGARTGGGTNWSNGCNATHWSNWSNWSNWSNWSNTAYATHTAYTAYGCNGAYWSNGTNAARGGNMGNTTYACNATHWSNMGNGAYAAYGCNAARAAYWSNMTNTAYMTNCARATGAAYWSNMTNMGNGCNGARGAYACNGCNGTNTAYTAYTGYGCNMGNGAYMGNGTNGGNGCNACNCCNGAYGCNTTYGAYATHTGGGGNCARGGNACNATGGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 578 - protein, 1362 aa, Homo Sapiens
GARGTNCARMTNMTNGARWSNGGNGGNGGNMTNGTNCARCCNGGNGGNWSNMTNMGNMTNWSNTGYGCNGCNWSNGGNTTYACNTTYWSNWSNTAYGCNATGAAYTGGGTNMGNCARGCNCCNGGNAARGGNMTNGARTGGGTNWSNGCNATHWSNGGNWSNGGNGGNWSNACNTAYTAYGCNGAYWSNGTNAARGGNMGNTTYACNATHWSNMGNGAYAAYWSNAARAAYACNMTNTAYMTNCARATGAAYWSNMTNMGNGCNGARGAYACNGCNGTNTAYTAYTGYGCNAARGARGGNATHGCNGTNGCNGGNACNGCNGARTAYTAYTAYTAYTAYGCNATGGAYGTNTGGGGNCARGGNACNACNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 579 - protein, 1353 aa, Homo Sapiens
GARGTNCARMTNMTNGARWSNGGNGGNGGNMTNGTNCARCCNGGNGGNWSNMTNMGNMTNWSNTGYGCNGCNWSNGGNTTYACNTTYWSNWSNTAYGCNATGWSNTGGGTNMGNCARGCNCCNGGNAARGGNMTNGARTGGGTNWSNGCNATHWSNGGNWSNGGNGGNWSNACNTAYTAYGCNGAYWSNGTNAARGGNMGNTTYACNATHWSNMGNGAYAAYWSNAARAAYACNMTNTAYMTNCARATGAAYWSNMTNMGNGCNGARGAYACNGCNGTNTAYTAYTGYGCNAARGARGGNATHGCNGCNMGNGAYWSNTAYTAYTAYTAYGCNATGGAYGTNTGGGGNCARGGNACNACNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 580 - protein, 1353 aa, Homo Sapiens
GARGTNCARMTNMTNGARWSNGGNGGNGGNMTNGTNCARCCNGGNGGNWSNMTNMGNMTNWSNTGYACNGCNWSNGGNTTYACNTTYWSNWSNTAYGCNATGWSNTGGGTNMGNCARGCNCCNGGNAARGGNMTNGARTGGGTNWSNGCNATHWSNGGNWSNGGNGGNWSNACNTAYTAYGCNGAYWSNGTNAARGGNMGNTTYACNATHWSNMGNGAYAAYWSNAARAAYACNMTNTAYMTNCARATGAAYWSNMTNMGNGCNGARGAYACNGCNGARTAYTAYTGYGCNAARGARGGNATHGCNGGNMGNGAYWSNTAYTAYTAYTAYGGNATGGAYGTNTGGGGNCARGGNACNACNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 581 - protein, 1347 aa, Homo Sapiens
CARGTNCARMTNGTNGARWSNGGNGGNGGNGTNGTNCARCCNGGNMGNWSNMTNMGNMTNWSNTGYGCNGCNWSNGGNTTYACNTTYWSNWSNTAYGGNATGCAYTGGGTNMGNCARGCNCCNGGNAARGGNMTNGARTGGGTNGCNTTYATHWSNGAYGAYGGNWSNACNAARTAYTAYGCNGAYWSNGTNAARGGNMGNTTYACNATHWSNMGNGAYAAYWSNATGAAYACNMTNTAYMTNCARATGAAYWSNMTNMGNGCNGARGAYACNGCNGTNTAYTAYTGYGCNMGNWSNTAYTAYGAYWSNWSNGGNTAYTAYTAYGGNTTYGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 582 - protein, 1320 aa, Homo Sapiens
CARGTNCARMTNGTNGARWSNGGNGGNGGNGTNGTNCARCCNGGNMGNWSNMTNMGNMTNWSNTGYGCNGCNWSNGGNTTYACNTTYWSNWSNTAYGGNATGCAYTGGGTNMGNCARGCNCCNGGNAARGGNMTNGARTGGGTNGCNGTNATHTGGTAYGAYGGNWSNAAYAARTAYTAYGCNGAYWSNGTNAARGGNMGNTTYACNATHWSNMGNGAYAAYWSNAARAAYACNMTNTAYMTNCARATGAAYWSNMTNMGNGCNGARGAYACNGCNGTNTAYTAYTGYGCNMGNAAYGTNATHGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 583 - protein, 1338 aa, Homo Sapiens
CARGTNCARMTNGTNGARWSNGGNGGNGGNGTNGTNCARCCNGGNMGNWSNMTNMGNMTNWSNTGYGCNGCNWSNGGNTTYACNTTYWSNWSNTAYGAYATGCAYTGGGTNMGNCARGCNCCNGGNAARGGNMTNGARTGGGTNGCNGTNATHTGGTAYGAYGGNWSNATHAARTAYTAYGCNGAYWSNGTNAARGGNMGNTTYACNATHWSNMGNGAYAAYWSNAARAAYACNMTNTAYMTNCARATGAAYWSNMTNMGNGCNGARGAYACNGCNGTNTAYTAYTGYGCNMGNGGNGGNGCNACNGGNGCNGARTAYTTYCARCAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 584 - protein, 1332 aa, Homo Sapiens
CARGTNCARMTNGTNGARWSNGGNGGNGGNGTNGTNCARCCNGGNMGNWSNMTNMGNMTNWSNTGYGCNGCNWSNGGNTTYACNTTYWSNWSNTAYGGNATGCAYTGGGTNMGNCARGCNCCNGGNAARGGNMTNGARTGGGTNGCNGTNATHTGGTAYGAYGGNWSNAAYAARTAYTAYGCNGAYWSNGTNAARGGNMGNTTYACNATHWSNMGNGAYAAYWSNAARAAYACNMTNTAYMTNCARATGAAYWSNMTNMGNGCNGARGAYACNGCNGTNTAYTAYTGYGTNMTNMTNTGGTTYGGNGARACNTTYGAYTAYTGGGGNCARGGNWSNMTNGTNACNGTNWSNCCNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 585 - protein, 1323 aa, Homo Sapiens
CARGTNCARMTNGTNGARWSNGGNGGNGGNGTNGTNCARCCNGGNMGNWSNMTNMGNMTNWSNTGYGCNGCNWSNGGNTTYACNTTYWSNWSNTAYGGNATGCAYTGGGTNMGNCARGCNCCNGGNAARGGNMTNGARTGGGTNGCNGTNATHTGGWSNGAYGGNWSNAAYAARTAYTAYGCNGAYWSNGTNAARGGNMGNTTYACNATHWSNMGNGAYAAYWSNAARAAYACNMTNTAYMTNCARATGAAYWSNMTNMGNGCNGARGAYACNGCNGTNTAYTAYTGYGCNMGNAAYMTNCCNTTYGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 586 - protein, 1347 aa, Homo Sapiens
CARGTNCARMTNGTNGARWSNGGNGGNGGNGTNGTNCARCCNGGNMGNWSNMTNMGNMTNWSNTGYGCNGCNWSNGGNTTYACNTTYWSNWSNTAYGGNATGCAYTGGGTNMGNCARGCNCCNGGNAARGGNMTNGARTGGGTNGCNGTNATHTGGGAYGAYGGNWSNAAYCARTAYTAYACNGAYWSNGTNAARGGNMGNTTYACNGTNWSNMGNGAYAAYWSNAARAAYACNMTNTTYMTNCARATGAAYWSNMTNMGNGCNGARGAYACNGCNGTNTAYTAYTGYGCNMGNWSNCAYTAYGGNGGNGAYTAYGAYTAYTAYGGNATGGAYGTNTGGGGNCARGGNACNACNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 587 - protein, 1338 aa, Homo Sapiens
CARGTNCARMTNGTNGARWSNGGNGGNGGNGTNGTNCARCCNGGNMGNWSNMTNMGNMTNWSNTGYGCNGCNWSNGGNTTYACNTTYWSNWSNTAYGGNATGCAYTGGGTNMGNCARGCNCCNGGNAARGGNMTNGARTGGGTNGCNGTNATHTGGTAYGAYGGNWSNAAYAARMGNTAYGTNGAYWSNGTNAARGGNMGNTTYACNATHWSNMGNGAYAAYWSNAARAAYACNMTNTAYMTNCARATGAAYWSNMTNMGNGCNGARGAYACNGCNGTNTAYTAYTGYGCNMGNGAYGGNTGGCARCARCARGCNCCNTTYGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 588 - protein, 1332 aa, Homo Sapiens
CARGTNCARMTNGTNGARWSNGGNGGNGGNGTNGTNCARCCNGGNMGNWSNMTNMGNMTNWSNTGYGCNGCNWSNGGNTTYACNTTYMGNWSNCAYGGNATGCAYTGGGTNMGNCARGCNCCNGGNAARGGNMTNGARTGGGTNGCNGTNATHTGGTAYGAYGGNWSNAAYAARAAYTAYGCNGAYWSNGTNMGNGGNMGNTTYACNATHWSNMGNGAYAAYWSNAARAAYACNMTNGAYMTNCARATGAAYWSNMTNMGNGCNGARGAYACNGCNGTNTAYTAYTGYGCNMGNTGGGGNATHWSNGCNCCNTTYGAYTGYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 589 - protein, 1323 aa, Homo Sapiens
GARGTNCARMTNGTNGARWSNGGNGGNGGNMTNGTNCARCCNGGNGGNWSNMTNMGNMTNWSNTGYGCNGCNWSNGGNTTYACNTTYWSNGCNTAYWSNATGAAYTGGGTNMGNCARGCNCCNGGNAARGGNMTNGARTGGGTNWSNTAYATHWSNWSNWSNGGNMGNACNATHTAYTAYGCNGAYWSNGTNAARGGNMGNTTYACNATHWSNMGNGAYAAYGCNAARAAYWSNMTNTTYMTNCARATGAAYWSNMTNMGNGAYGARGAYACNGCNGTNTAYTAYTGYGCNMTNTGGGCNCCNTTYGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 590 - protein, 1353 aa, Homo Sapiens
GARGTNCARMTNGTNGARWSNGGNGGNGGNMTNGTNCARCCNGGNGGNWSNMTNMGNMTNWSNTGYGCNGCNWSNGGNTTYACNTTYWSNWSNTAYWSNATGAAYTGGGTNMGNCARGCNCCNGGNAARGGNMTNGARTGGGTNWSNCAYATHWSNWSNWSNWSNMGNACNATHTAYTAYGCNGAYWSNGTNAARGGNMGNTTYACNATHWSNMGNGAYAAYGCNAARAAYWSNGTNTAYMTNCARATGAAYWSNMTNMGNGAYGARGAYACNGCNGTNTAYTAYTGYGCNMGNGAYGGNTAYAAYTGGAAYGGNGGNGGNAAYTAYTAYGGNATGGAYGTNTGGGGNCARGGNACNACNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 591 - protein, 1353 aa, Homo Sapiens
GARGTNCARMTNGTNGARWSNGGNGGNGGNMTNGTNCARCCNGGNGGNWSNMTNMGNMTNWSNTGYGCNGCNWSNGGNTTYACNTTYWSNWSNTAYWSNATGAAYTGGGTNMGNCARGCNCCNGGNAARGGNMTNGARTGGGTNWSNCAYATHWSNMGNWSNWSNMGNACNATHTAYTAYGCNGAYWSNGTNAARGGNMGNTTYACNATHWSNMGNGAYAAYGCNAARAAYWSNMTNTAYMTNCARATGAAYWSNMTNMGNGAYGARGAYACNGCNGTNTAYTAYTGYGCNMGNGAYGGNTAYAAYTGGAAYAAYGGNGGNTAYTAYTAYGGNATGGAYGTNTGGGGNCARGGNACNACNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 592 - protein, 1332 aa, Homo Sapiens
CARGTNCARMTNCARGARWSNGGNCCNGGNMTNGTNAARCCNWSNCARACNMTNWSNMTNACNTGYACNGTNWSNGGNGGNWSNGTNWSNWSNGGNGGNTAYTAYTGGWSNTGGATHMGNCARCAYCCNGGNAARGGNMTNGARTGGATHGGNTAYATHCAYWSNWSNGGNWSNACNTAYTAYAAYCCNWSNMTNAARWSNMGNGTNACNATHWSNGTNGAYACNWSNAARAAYCARTTYWSNMTNAAYMTNWSNWSNGTNACNGCNGCNGAYACNGCNGTNTAYTAYTGYGCNMGNGGNCCNTAYTAYGGNATGGAYGTNTGGGGNCARGGNACNACNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 593 - protein, 1359 aa, Homo Sapiens
CARGTNCARMTNCARGARWSNGGNCCNGGNMTNGTNAARCCNWSNCARACNMTNWSNMTNACNTGYACNGTNWSNGGNGGNWSNATHWSNMGNGGNGGNTAYTAYTGGWSNTGGATHMGNCARCAYCCNGGNAARGGNMTNGARTGGATHGGNTAYATHTAYCAYWSNGGNWSNACNTAYTAYAAYCCNWSNMTNAARWSNMGNGTNAAYATGWSNGTNGAYACNWSNAARAAYCARTTYWSNMTNAARMTNWSNWSNGTNACNGCNGCNGAYACNGCNGTNTAYTAYTGYGCNMGNGCNMTNMGNGGNATHGTNMTNATGGTNTAYGTNMTNGGNGCNMTNGAYATHTGGGGNCARGGNACNAARGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 594 - protein, 1359 aa, Homo Sapiens
CARGTNCARMTNCARGARWSNGGNCCNGGNMTNGTNAARCCNWSNCARACNMTNWSNMTNACNTGYACNGTNWSNGGNGGNWSNATHWSNWSNGGNGGNTAYTAYTGGWSNTGGATHMGNCARCAYCCNGGNAARGGNMTNGARTGGATHGGNTAYATHTAYTAYWSNGGNWSNACNTAYTAYAAYCCNWSNMTNAARWSNMGNGTNACNATHWSNGTNGAYACNWSNAARAAYCARTTYWSNMTNAARMTNWSNWSNGTNACNGCNGCNGAYACNGCNGTNTAYTAYTGYGCNMGNGAYGARACNGTNGTNMGNGGNMTNATHMGNTAYTGYTAYGGNATGGAYGTNTGGGGNCARGGNACNACNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 595 - protein, 1344 aa, Homo Sapiens
CARGTNCARMTNCARGARWSNGGNCCNGGNMTNGTNAARCCNWSNCARACNMTNWSNMTNAAYTGYACNGTNWSNGGNGGNWSNATHWSNWSNGGNGGNTAYTAYTGGWSNTGGATHMGNCARCAYCCNGGNAARGGNMTNGARTGGATHGGNTAYATHCAYTAYWSNGGNWSNACNTAYTAYAAYCCNWSNMTNAARWSNMGNATHACNATHWSNGCNGAYACNWSNAARAAYCARTTYWSNMTNAARMTNAAYWSNGTNACNGCNGCNGAYACNGCNGTNTAYTAYTGYGCNMGNGAYMGNGGNGGNGGNGAYTAYGGNMGNATGGAYGTNTGGGGNCARGGNACNACNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 596 - protein, 1344 aa, Homo Sapiens; identical to SEQ ID NO: 595

SEQ ID NO: 597 - protein, 1335 aa, Homo Sapiens
CARGTNCARMTNCARGARWSNGGNCCNGGNMTNGTNAARCCNWSNCARACNMTNWSNMTNACNTGYACNGTNWSNGGNGGNWSNATHWSNWSNGGNGGNTAYTAYTGGWSNTGGATHMGNCARCAYCCNGGNAARGGNMTNGARTGGATHGGNTAYATHCAYWSNWSNGGNWSNACNTAYTAYAAYCCNWSNMTNAARWSNMGNATHACNAARWSNGTNGAYACNWSNAARAAYCARTTYWSNMTNAARMTNWSNWSNGTNACNGCNGCNGAYACNGCNGTNTAYTAYTGYGCNMGNWSNAAYAAYTAYGGNTGYTTYGCNMTNTGGGGNMGNGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 598 - protein, 1335 aa, Homo Sapiens; identical to SEQ ID NO: 597

SEQ ID NO: 599 - protein, 1377 aa, Homo Sapiens
CARGTNCARMTNCARGARWSNGGNCCNGGNMTNGTNAARCCNWSNCARACNMTNWSNMTNACNTGYACNGTNWSNGGNGGNWSNATHWSNWSNGGNGGNTAYTAYTGGWSNTGGATHMGNCARCAYCCNGGNAARGGNMTNGARTGGATHGGNTAYATHCAYTAYWSNGGNWSNACNTAYTAYAAYCCNWSNMTNAARWSNMGNGTNACNATHWSNGTNGAYACNWSNAARAAYCARTTYWSNMTNAARMTNWSNWSNGTNACNGCNGCNGAYACNGCNGTNTAYTAYTGYGCNWSNGGNTAYAAYTAYGGNMTNTAYTAYTAYGAYWSNWSNGGNTAYCCNWSNTAYTAYTAYGGNATGGAYGTNTGGGGNCARGGNACNACNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 600 - protein, 1353 aa, Homo Sapiens
CARGTNCARMTNCARGARWSNGGNCCNGGNMTNGTNAARCCNWSNCARACNMTNWSNMTNACNTGYACNGTNWSNGGNGGNWSNATHWSNWSNGGNGAYTAYTAYTGGAAYTGGGTNMGNCARCAYCCNGGNAARGGNMTNGARTGGATHGGNTAYATHTAYTAYWSNGGNGGNACNTAYTAYAAYCCNWSNMTNAARWSNMGNGTNACNATHWSNGTNGAYACNWSNAARAAYCARTTYWSNMTNAARMTNTTYWSNGTNACNGCNGCNGAYACNGCNGTNTAYTTYTGYGCNMGNACNTAYTAYGAYATHMTNACNGGNTAYCCNTTYTAYTTYGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 601 - protein, 1353 aa, Homo Sapiens; identical to SEQ ID NO: 600

SEQ ID NO: 602 - protein, 1338 aa, Homo Sapiens
CARGTNCARMTNCARCARTGGGGNGCNGGNMTNMTNAARCCNWSNGARACNMTNWSNMTNACNTGYGCNGTNTAYGGNGGNWSNTTYWSNGGNTAYTAYTGGWSNTGGATHMGNCARCCNCCNGGNAARGGNMTNGARTGGATHGGNGARATHAAYCAYWSNGGNWSNACNAAYTAYAAYCCNWSNMTNAARWSNMGNGTNACNATHWSNGTNGAYACNWSNAARAAYCARTTYWSNMTNAARMTNWSNWSNGTNACNGCNGCNGAYACNGCNGTNTAYTAYTGYGCNMGNGGNGGNTAYWSNWSNWSNTGGTAYTGGTTYGAYCCNTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 603 - protein, 1338 aa, Homo Sapiens
CARGTNCARMTNCARCARTGGGGNGCNGGNMTNMTNAARCCNWSNGARACNMTNWSNMTNACNTGYGCNGTNTAYGGNGGNWSNTTYWSNGGNTAYTAYTGGWSNTGGATHMGNCARCCNCCNGGNAARGGNMTNGARTGGATHGGNGARATHAAYCAYWSNGGNWSNACNAAYTAYAAYCCNWSNMTNAARWSNMGNGTNACNATHWSNGTNGAYACNWSNAARAAYCARTTYWSNMTNAARMTNWSNWSNGTNACNGCNGCNGAYACNGCNGTNTAYTAYTGYGCNMGNGGNGGNTAYWSNWSNWSNTGGTTYTGGTTYGAYCCNTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 604 - protein, 1347 aa, Homo Sapiens
CARGTNCARMTNCARGARWSNGGNCCNGGNMTNGTNAARCCNWSNGARACNMTNWSNMTNACNTGYACNGTNWSNGGNGGNWSNATHWSNWSNTAYTAYTGGWSNTGGATHMGNCARCCNGCNGGNAARGGNMTNGARTGGATHGGNMGNATHTAYACNWSNGGNACNACNAAYTAYAAYCCNWSNMTNAARWSNMGNGTNACNATGWSNGTNGAYACNWSNAARAAYCARTTYWSNMTNAARMTNWSNWSNGTNACNGCNGCNGAYACNGCNGTNTAYTAYTGYGCNMGNGAYGGNTAYWSNTAYGGNCAYTAYTAYTAYTAYGGNATGGAYGTNTGGGGNCARGGNACNACNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 605 - protein, 1356 aa, Homo Sapiens
CARGTNCARMTNCARGARWSNGGNCCNGGNMTNGTNAARCCNWSNGARACNMTNWSNMTNACNTGYACNGTNWSNGGNGGNWSNGTNWSNWSNGGNGGNWSNTAYTGGWSNTGGATHMGNCARCCNCCNGGNAARGGNMTNGARTGGATHGGNTAYATHTAYTAYWSNGGNWSNACNAAYTAYAAYCCNWSNMTNAARWSNMGNGTNACNATHWSNATHGTNACNWSNMGNAAYCARTTYWSNMTNAARMTNWSNWSNGTNACNGCNGCNGAYACNGCNGTNTAYTAYTGYGCNMGNWSNGCNMTNMGNTAYTTYGAYTGGMTNTTYWSNGAYGTNWSNGAYATHTGGGGNCARGGNACNATGGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 606 - protein, 1338 aa, Homo Sapiens
GARGTNCARMTNGTNCARWSNGGNGCNGARMTNAARAARCCNGGNGARWSNMTNAARATHWSNTGYAARGGNWSNGGNTAYMGNTTYACNWSNTAYTGGATHGGNTGGGTNMGNCARATGCCNGGNAARGGNMTNGARTGGATGGGNATHATHTAYCCNGAYGAYWSNGAYACNMGNTAYWSNCCNWSNTTYCARGGNCARGTNACNATHWSNGCNGAYAARWSNATHWSNACNGCNTAYMTNCARTGGWSNWSNMTNAARGCNWSNGAYACNGCNATGTAYTAYTGYGCNMGNCARAARWSNTAYGGNTAYWSNTAYTTYGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 607 - protein, 1341 aa, Homo Sapiens
GARGTNCARMTNGTNCARWSNGGNGCNGARGTNAARAARCCNGGNGARWSNMTNAARATHWSNTGYAARGGNWSNGGNTAYWSNTTYACNWSNTAYTGGATHGGNTGGGTNMGNCARATGCCNGGNAARGGNMTNGARTGGATGGGNATHATHTAYCCNGAYGAYWSNGAYGCNMGNTAYWSNCCNWSNTTYCARGGNCARGTNACNATHWSNGCNGAYAARWSNATHAAYACNGCNTAYMTNCARTGGWSNWSNMTNAARGCNWSNGAYACNGCNATGTAYTAYTGYGCNMGNCARGGNTAYGGNWSNGGNTGGGGNTAYTTYGAYTAYTGGGGNCARGGNACNMTNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 608 - protein, 1359 aa, Homo Sapiens
GARGTNCARMTNGTNCARWSNGGNGCNGARGTNAARAARCCNGGNGARWSNMTNAARATHWSNTGYAARGGNWSNGGNTAYWSNTTYACNWSNTAYTGGATHGGNTGGGTNMGNCARATGCCNGGNAARGGNMTNGARTGGATGGGNATHATHTAYCCNGGNGAYWSNGAYATHMGNTAYWSNCCNWSNTTYCARGGNCARGTNACNATHWSNGCNGAYAARWSNATHWSNACNGCNTAYMTNCARTGGWSNWSNMTNAARGCNWSNGAYACNGCNATGTAYTAYTGYGCNMGNCARGGNMTNGCNGTNGCNGGNACNWSNTAYTAYTAYTAYTAYGGNATGGAYGTNTGGGGNCARGGNACNACNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 609 - protein, 1353 aa, Homo Sapiens
CARGTNCARMTNCARCARWSNGGNCCNGGNMTNGTNAARCCNWSNCARACNMTNWSNMTNACNTGYGCNATHWSNGGNGAYWSNGTNWSNWSNTAYWSNGCNGCNTGGAAYTGGATHMGNCARWSNCCNWSNMGNGGNMTNGARTGGMTNGGNMGNACNTAYTGYMGNWSNAARTGGTAYAAYGAYTAYGCNGTNWSNGTNAARWSNMGNATHACNATHAAYCCNGAYACNWSNAARAAYCARTTYWSNMTNCARMTNAAYWSNGTNACNCCNGARGAYACNGCNGTNTAYTAYTGYGCNMGNGAYMGNGCNGTNGCNGGNTAYTAYTAYGGNATGGAYGTNTGGGGNCARGGNACNACNGTNACNGTNWSNWSNGCNWSNACNAARGGNCCNWSNGTNTTYCCNMTNGCNCCNTGYWSNMGNWSNACNWSNGARWSNACNGCNGCNMTNGGNTGYMTNGTNAARGAYTAYTTYCCNGARCCNGTNACNGTNWSNTGGAAYWSNGGNGCNMTNACNWSNGGNGTNCAYACNTTYCCNGCNGTNMTNCARWSNWSNGGNMTNTAYWSNMTNWSNWSNGTNGTNACNGTNCCNWSNWSNAAYTTYGGNACNCARACNTAYACNTGYAAYGTNGAYCAYAARCCNWSNAAYACNAARGTNGAYAARACNGTNGARMGNAARTGYTGYGTNGARTGYCCNCCNTGYCCNGCNCCNCCNGTNGCNGGNCCNWSNGTNTTYMTNTTYCCNCCNAARCCNAARGAYACNMTNATGATHWSNMGNACNCCNGARGTNACNTGYGTNGTNGTNGAYGTNWSNCAYGARGAYCCNGARGTNCARTTYAAYTGGTAYGTNGAYGGNGTNGARGTNCAYAAYGCNAARACNAARCCNMGNGARGARCARTTYAAYWSNACNTTYMGNGTNGTNWSNGTNMTNACNGTNGTNCAYCARGAYTGGMTNAAYGGNAARGARTAYAARTGYAARGTNWSNAAYAARGGNMTNCCNGCNCCNATHGARAARACNATHWSNAARACNAARGGNCARCCNMGNGARCCNCARGTNTAYACNMTNCCNCCNWSNMGNGARGARATGACNAARAAYCARGTNWSNMTNACNTGYMTNGTNAARGGNTTYTAYCCNWSNGAYATHGCNGTNGARTGGGARWSNAAYGGNCARCCNGARAAYAAYTAYAARACNACNCCNCCNATGMTNGAYWSNGAYGGNWSNTTYTTYMTNTAYWSNAARMTNACNGTNGAYAARWSNMGNTGGCARCARGGNAAYGTNTTYWSNTGYWSNGTNATGCAYGARGCNMTNCAYAAYCAYTAYACNCARAARWSNMTNWSNMTNWSNCCNGGNAAR

SEQ ID NO: 610 - protein, 336 aa, Homo Sapiens
GAYGTNGTNATGCANCARWSNCCNYTNWSNYTNCCNGTNCANYTNGGNCARCCNGCNWSNATHWSNTGYMGNWSNWSNCARWSNYTNGTNTAYWSNGAYGGNAAYCANTAYYTNAAYTGGTTYCARCARMGNCCNGGNCARWSNCCNMGNMGNYTNATHTAYAARGTNWSNAAYTGGGAYWSNGGNGTNCCNGAYMGNTTYAAYGGNWSNGGNWSNGGNCANGAYTTYCANYTNAARATHWSNMGNGTNGARGCNGARGAYGTNGGNGTNTAYTAYTGYATGCARWSNCANCAYTGGCCNATHCANTTYGGNCARGGNCANMGNYTNGARATHAAR

SEQ ID NO: 611 - protein, 336 aa, Homo Sapiens
GAYGTNGTNATGCANCARWSNCCNYTNWSNYTNCCNGTNCANYTNGGNCARCCNGCNWSNATHWSNTGYMGNWSNWSNCARWSNYTNGTNTAYWSNGAYGGNAAYCANTAYYTNAAYTGGTTYCARCARMGNCCNGGNCARWSNCCNMGNMGNYTNATHTAYAARGTNWSNAAYTGGGAYWSNGGNGTNCCNGAYMGNTTYWSNGGNWSNGGNWSNGGNCANGAYTTYCANYTNAARATHWSNMGNGTNGARGCNGARGAYGTNGGNGTNTAYTAYTGYATHCARGGNCANCAYTGGCCNCANCANTTYGGNCARGGNCANMGNYTNGARATHAAR

SEQ ID NO: 612 - protein, 336 aa, Homo Sapiens
GAYGTNGTNATGCANCARWSNCCNYTNWSNYTNCCNGTNCANYTNGGNCARCCNGCNWSNATHWSNTGYMGNWSNWSNCARWSNYTNGTNTAYWSNGAYGGNAAYCANTAYYTNAAYTGGYTNCARCARMGNCCNGGNCARWSNCCNMGNMGNYTNATHTAYAARGTNWSNAAYTGGGAYWSNGGNGTNCCNGAYMGNTTYWSNGGNWSNGGNWSNGGNCANGAYTTYCANYTNAARATHWSNMGNGTNGARGCNGARGAYGTNGGNGTNTAYTAYTGYATGCARGGNCANCAYTGGCCNATHCANTTYGGNCARGGNCANMGNYTNGARATHAAR

SEQ ID NO: 613 - protein, 336 aa, Homo Sapiens
GAYATHGTNATGCANCARCANCCNYTNWSNYTNWSNGTNCANCCNGGNCARCCNGCNWSNATHWSNTGYAARWSNWSNCARWSNYTNYTNCAYWSNGAYGGNAARCANTAYYTNTAYTGGTAYYTNCARAARCCNGGNCARCCNCCNCARYTNYTNATHTAYGARGTNWSNAAYMGNTTYWSNGGNGTNCCNGAYMGNTTYWSNGGNWSNGGNWSNGGNCANGAYTTYCANYTNAARATHWSNMGNGTNGARGCNGARGAYGTNGGNGTNTAYTAYTGYATGCARGGNATHCARYTNCCNTGYWSNTTYGGNCARGGNCANAARYTNGARATHAAR

SEQ ID NO: 614 - protein, 336 aa, Homo Sapiens
GAYATHGTNATGCANCARCANCCNYTNWSNYTNWSNGTNCANCCNGGNCARCCNGCNWSNATHWSNTGYAARWSNWSNCARWSNYTNYTNCAYWSNGAYGGNAARCANTAYYTNTAYTGGTAYYTNCARAARCCNGGNCARCCNCCNCARYTNYTNATHTAYGARGTNWSNAAYMGNTTYWSNGGNGTNCCNGAYMGNTTYWSNGGNWSNGGNWSNGGNCANGAYTTYCANYTNAARATHWSNMGNGTNGARGCNGARGAYGTNGGNGTNTAYTAYTGYATGCARWSNATHCARYTNCCNYTNCANTTYGGNGGNGGNCANAARGTNGARATHAAR

SEQ ID NO: 615 - protein, 336 aa, Homo Sapiens
GAYATHGTNATGCANCARCANCCNYTNWSNYTNWSNGTNCANCCNGGNCARCCNGCNWSNATHWSNTGYAARWSNWSNCARWSNYTNYTNCAYWSNGAYGGNAARCANTAYYTNTAYTGGTTYYTNCARAARCCNGGNCARCCNCCNCARCCNYTNATHTAYGARGTNWSNAAYMGNTTYWSNGGNGTNCCNGAYMGNTTYWSNGGNWSNGGNWSNGGNCANGAYTTYCANYTNAARATHWSNMGNGTNGARGCNGARGAYGTNGGNGTNTAYTAYTGYATGCARWSNATHCARYTNCCNATHCANTTYGGNCAYGGNCANMGNYTNGARATHAAR

SEQ ID NO: 616 - protein, 321 aa, Homo Sapiens
GAYATHCARATGCANCARWSNCCNWSNWSNYTNWSNGCNWSNGTNGGNGAYMGNGTNCANATHCANTGYMGNGCNWSNCARGGNATHGCNAAYTAYYTNGCNTGGTAYCARCARAARCCNGGNAARGTNCCNAARYTNYTNATHTAYGTNGCNWSNCANYTNCARWSNGGNGTNCCNWSNMGNTTYWSNGGNWSNGGNWSNGGNCANGAYTTYCANYTNCANATHWSNWSNYTNCARCCNGARGAYGTNGCNCANTAYTAYTGYCARAAYTAYAAYWSNGCNCCNTTYCANTTYGGNCCNGGNCANAARGTNGAYATHAAR

SEQ ID NO: 617 - protein, 321 aa, Homo Sapiens
GAYATHCARATGCANCARWSNCCNWSNWSNYTNWSNGCNWSNGTNGGNGAYMGNGTNCANATHATHTGYMGNGCNWSNCARGGNATHWSNAAYGAYYTNGCNTGGTAYCARCARAARCCNGGNAARGTNCCNAARYTNYTNATHTAYGCNGCNWSNCANYTNCARWSNGGNGTNCCNWSNMGNTTYWSNGGNWSNGGNWSNGGNCANGAYTTYCANYTNCANATHWSNWSNYTNCARCCNGARGAYGTNGCNCANTAYTAYTGYCARAARTAYAAYWSNGTNCCNYTNCANTTYGGNGGNGGNCANAARGTNGARATHAAR

SEQ ID NO: 618 - protein, 336 aa, Homo Sapiens
AAYATHGTNATGCANCARCANCCNYTNWSNWSNCCNGTNCANYTNGGNCARCCNGCNWSNATHWSNTGYMGNWSNWSNCARWSNYTNGTNCAYWSNGAYGGNAAYCANTAYYTNWSNTGGYTNCARCARMGNCCNGGNCARCCNCCNMGNYTNYTNATHTAYAARATHWSNAAYMGNTTYWSNGGNGTNCCNGAYMGNTTYWSNGGNWSNGGNGCNGGNCANGAYTTYCANYTNAARATHWSNMGNGTNGARGCNGARGAYGTNGGNGTNTAYTAYTGYATGCARGCNCANCARTTYCCNCAYCANTTYGGNCCNGGNCANAARGTNGAYATHAAR

SEQ ID NO: 619 - protein, 336 aa, Homo Sapiens
GARATHGTNATGCANCARCANCCNYTNWSNWSNCCNGTNCANYTNGGNCARCCNGCNWSNATHWSNTGYMGNWSNWSNCARWSNYTNGTNCAYWSNGAYGGNAAYCANTAYYTNWSNTGGYTNCARCARMGNCCNGGNCARCCNCCNMGNYTNYTNATHTAYAARATHWSNAAYMGNTTYWSNGGNGTNCCNGAYMGNTTYWSNGGNCANGGNGCNGGNCANGAYTTYCANYTNAARATHWSNMGNGTNGARGCNGARGAYGTNGGNGTNTAYTAYTGYATGCARGCNCANCARTTYCCNCAYCANTTYGGNGGNGGNCANAARGTNGARATHAAR

SEQ ID NO: 620 - protein, 324 aa, Homo Sapiens
GARATHGTNYTNCANCARWSNCCNGGNCANYTNWSNYTNWSNCCNGGNGARMGNGCNCANYTNWSNTGYMGNGCNWSNCARCANGTNATHWSNWSNTAYYTNGCNTGGTAYCARCARAARCCNGGNCARGCNCCNMGNYTNYTNATHWSNGGNGCNWSNWSNMGNGCNCANGGNATHCCNGAYMGNTTYWSNGGNWSNGGNWSNGGNCANGAYTTYCANYTNCANATHWSNMGNYTNGARCCNGARGAYTTYGCNGTNTAYTAYTGYCARCARTAYGGNWSNWSNCCNMGNCANTTYGGNCARGGNCANAARGTNGARATHAAR

SEQ ID NO: 621 - protein, 318 aa, Homo Sapiens
GARATHGTNYTNCANCARWSNCCNGGNCANYTNWSNYTNWSNCCNGGNGARMGNGCNCANYTNWSNTGYMGNGCNWSNCARWSNGTNWSNMGNYTNGCNTGGTAYCARCARAARCCNGGNCARGCNCCNMGNYTNYTNATHTAYGGNGCNWSNMGNMGNGCNCANGGNATHCCNGAYMGNTTYWSNGGNWSNGGNWSNGGNCANGAYTTYCANYTNCANATHWSNMGNYTNGARCCNGARGAYTTYGCNGTNTAYTAYTGYCARCARTAYGGNWSNWSNCCNMGNWSNTTYGGNCARGGNCANAARYTNGARATHAAR

SEQ ID NO: 622 - protein, 321 aa, Homo Sapiens
GAYATHCARATGCANCARWSNCCNWSNWSNYTNWSNGCNWSNGTNGGNGAYMGNGTNCANATHCANTGYMGNGCNWSNCARGGNATHMGNAAYGAYYTNGGNTGGTAYCARCARAARCCNGGNAARGCNCCNAARMGNYTNATHTAYGCNGCNWSNWSNYTNCARWSNGGNGTNCCNWSNMGNTTYWSNGGNWSNGGNWSNGGNCANGARTTYCANYTNCANATHWSNWSNYTNCARCCNGARGAYTTYGCNCANTAYTAYTGYYTNCARCAYAAYWSNTAYCCNCCNCANTTYGGNCARGGNCANAARGTNGARATHAAR

SEQ ID NO: 623 - protein, 339 aa, Homo Sapiens
GAYATHGTNATGCANCARWSNCCNGAYWSNYTNGCNGTNWSNYTNGGNGARMGNGCNCANATHAAYTGYAARWSNWSNCARWSNGTNYTNTAYWSNWSNAAYAAYAARAAYTAYYTNGTNTGGTAYCARCARAARCCNGGNCARCCNCCNAARYTNTTYATHTAYTGGGCNWSNCANMGNGARWSNGGNGTNCCNGAYMGNTTYCANGGNWSNGGNWSNGGNCANGAYTTYCANYTNCANATHWSNWSNYTNCARGCNGARGAYGTNGCNGTNTAYTAYTGYCARCARTAYTAYWSNTTYCCNTGGCANTTYGGNCARGGNCANAARGTNGARATHAAR

SEQ ID NO: 624 - protein, 339 aa, Homo Sapiens
GAYATHGTNATGCANCARWSNCCNGAYWSNYTNGCNGTNWSNYTNGGNGARMGNGCNCANATHAAYTGYAARWSNWSNCARWSNGTNYTNTAYWSNWSNAAYAAYAARAAYTAYYTNGCNTGGTAYCARCARAARCCNGGNCARCCNCCNAARYTNYTNATHTAYTGGGCNWSNCANMGNGARWSNGGNGTNCCNGAYMGNTTYWSNGGNWSNGGNWSNGGNCANGAYTTYCANYTNCANATHWSNWSNYTNCARGCNGARGAYGTNGCNGTNTAYTAYTGYCARCARTAYTAYWSNCANCANTGGCANTTYGGNCARGGNCANAARGTNGARATHAAR

SEQ ID NO: 625 - protein, 339 aa, Homo Sapiens
GAYATHGTNATGCANCARWSNCCNGAYWSNYTNGCNGTNWSNYTNGGNGARMGNGCNCANATHAAYTGYAARWSNWSNCARAAYGTNYTNTAYWSNWSNAAYAAYAARAAYTAYYTNGCNTGGTAYCARCARAARCCNGGNCARCCNCCNAARYTNYTNATHTAYTGGGCNWSNCANMGNGARWSNGGNGTNCCNGAYMGNTTYWSNGGNWSNGGNWSNGGNCANGAYTTYCANYTNCANATHWSNWSNYTNCARGCNGARGAYGTNGCNGTNTAYTTYTGYCARCARTAYTAYGGNCANCCNMGNCANTTYGGNCARGGNCANAARGTNGARATHAAR

SEQ ID NO: 626 - protein, 339 aa, Homo Sapiens; identical to SEQ ID NO: 625

SEQ ID NO: 627 - protein, 339 aa, Homo Sapiens
GAYATHGTNATGCANCARWSNCCNGAYWSNYTNCANGTNWSNYTNGGNGARMGNGCNCANATHAAYTGYAARWSNWSNCARWSNGTNYTNTAYWSNWSNAAYAAYAARAAYTAYYTNGCNTGGTAYCARCARAARCCNGGNCARCCNCCNAARYTNYTNATHTAYTGGGCNWSNCANMGNGARWSNGGNGTNCCNGAYMGNTTYGGNGGNWSNGGNWSNGGNCANGAYTTYCANYTNCANATHWSNWSNYTNCARGCNGARGAYGTNGCNGTNTAYTAYTGYCARCARTAYTAYWSNATHWSNMGNCANTTYGGNCARGGNCANAARGTNGARATHAAR

SEQ ID NO: 628 - protein, 339 aa, Homo Sapiens
GAYATHGTNATGCANCARWSNCCNGAYWSNYTNGCNGTNWSNYTNGGNGARMGNGCNCANATHAAYTGYAARWSNWSNCARWSNGTNYTNTAYAAYWSNAAYAAYAARAAYTAYYTNGCNTGGTAYCARCARAARCCNGGNCARCCNCCNAARYTNYTNATHTAYTGGGCNWSNCANMGNGARWSNGGNGTNCCNGAYMGNTTYWSNGGNWSNGGNWSNGGNCANGAYTTYCANYTNCANATHWSNWSNYTNCARGCNGAYGAYGTNGCNGTNTAYTAYTGYCARCARTAYTAYWSNCANCANTGGCANTTYGGNCCNGGNCANAARGTNGARATHAAR

SEQ ID NO: 629 - protein, 339 aa, Homo Sapiens; identical to SEQ ID NO: 628

SEQ ID NO: 630 - protein, 339 aa, Homo Sapiens
GAYATHGTNATGCANCARWSNCCNGAYWSNYTNGCNGTNWSNYTNGGNGARMGNGCNCANATHAAYTGYAARWSNWSNCARWSNGTNYTNTAYWSNWSNAAYAAYAARAAYTAYYTNGCNTGGTAYCARCARAARCCNGGNCARCCNCCNAARGTNYTNATHTAYTGGGCNWSNCANMGNAARWSNGGNGTNCCNGAYMGNTTYWSNGGNWSNGGNWSNGGNCANGAYTTYCANYTNCANATHWSNGGNYTNCARGCNGARGAYGTNGCNYTNTAYTAYTGYCARCARTAYTAYWSNCANATGTTYWSNTTYGGNCARGGNCANAARYTNGARATHAAR

SEQ ID NO: 631 - protein, 339 aa, Homo Sapiens
GAYATHGTNATGCANCARWSNCCNGAYWSNYTNGCNGTNWSNYTNGGNGARMGNGCNCANATHAAYTGYAARWSNWSNCARWSNGTNYTNGAYWSNWSNAAYAAYAARAAYTAYYTNGCNTGGTAYCARCARAARCCNGGNCARCCNCCNAARYTNYTNATHTAYTGGGCNWSNCANMGNGARWSNGGNGTNCCNGAYMGNTTYWSNGGNWSNGGNWSNGGNCANGAYTTYCANYTNCANATHWSNWSNYTNCARGCNGARGAYGTNGCNGTNTTYTAYTGYCAYCARTAYTAYWSNCANCCNYTNCANTTYGGNGGNGGNCANAARGTNGCNATHAAR

SEQ ID NO: 632 - protein, 339 aa, Homo Sapiens
GAYATHGTNATGCANCARWSNCCNGAYWSNYTNGCNGTNWSNYTNGGNGARMGNGCNCANATHAAYTGYAARWSNWSNCARWSNATHYTNTAYMGNWSNAAYAAYAARAAYTAYYTNGCNTGGTAYCARCARAARCCNGGNCARCCNCCNAARYTNYTNATHTAYTGGGCNWSNGCNMGNGARWSNGGNGTNCCNGAYMGNTTYWSNGGNWSNGGNWSNGGNCANGAYTTYCANYTNCANATHWSNWSNYTNCARGCNGARGAYGTNGCNGTNTAYTTYTGYCARCARTAYTTYATHCANCCNYTNCANTTYGGNGGNGGNCANAARGTNGARATHAAR

SEQ ID NO: 633 - protein, 321 aa, Homo Sapiens
GAYATHCARATGCANCARWSNCCNWSNWSNYTNWSNGCNWSNGTNGGNGAYMGNGTNCANATHCANTGYMGNGCNWSNCARGAYATHWSNCAYTAYYTNGCNTGGTTYCARCARAARCCNGGNAARGCNCCNAARWSNYTNATHTAYGCNGCNWSNWSNYTNCARWSNGGNGTNCCNWSNAARTTYWSNGGNWSNGGNWSNGGNCANGAYTTYCANYTNCANATHWSNWSNYTNCARCCNGARGAYTTYGCNCANTAYTAYTGYCARCARTAYAAYAAYTAYCCNTTYCANTTYGGNCCNGGNCANAARGTNGAYATHAAR

SEQ ID NO: 634 - protein, 321 aa, Homo Sapiens
GAYATHCARATGCANCARWSNCCNWSNWSNYTNWSNGCNWSNGTNGGNGAYMGNGTNGCNATHCANTGYMGNGCNWSNCARGAYATHWSNAAYTAYYTNGCNTGGYTNCARCARAARCCNGGNAARGCNCCNAARWSNYTNATHTAYGCNGCNWSNWSNYTNCARWSNGGNGTNCCNWSNMGNTTYWSNGGNWSNGGNWSNGGNCANGAYTTYCANYTNCANATHWSNWSNYTNCARCCNGARGAYTTYGCNCANTAYTAYTGYCARCARTAYAAYCANTAYCCNTTYCANTTYGGNCCNGGNCANAARATGGAYATHAAR

SEQ ID NO: 635 - protein, 324 aa, Homo Sapiens
GARATHGTNATGCANCARWSNCCNGCNCANYTNWSNGTNWSNCCNGGNGARMGNGCNCANYTNWSNTGYMGNGCNWSNCARWSNGTNWSNWSNAAYYTNGCNTGGTAYCARCARGAYCCNGGNCARGCNCCNMGNYTNYTNATHTAYGGNGCNWSNMGNMGNGCNCANGGNATHCCNGCNMGNTTYWSNGGNWSNGGNWSNGGNCANGARTTYCANYTNCANATHWSNWSNYTNCARWSNGARGAYTTYGCNGTNTAYTAYTGYCARCARCAYAAYAAYTGGCCNCCNTGGCANTTYGGNCARGGNCANAARGTNGARATHAAR

SEQ ID NO: 636 - protein, 321 aa, Homo Sapiens
GAYATHCARATGCANCARWSNCCNWSNWSNGTNWSNGCNWSNGTNGGNGAYMGNGTNCANATHCANTGYMGNGCNWSNCARGAYATHWSNMGNTGGYTNGCNTGGTAYCARCARAARCCNGGNAARGCNCCNAARYTNYTNATHTAYGCNGCNWSNWSNYTNCARWSNGGNGTNCCNWSNMGNTTYWSNGGNWSNGGNWSNGGNCANGAYTTYCANYTNCANATHWSNWSNYTNCARCCNGARGAYTTYGCNCANTAYTAYTGYCARCARGCNAAYWSNTTYCCNCCNCANTTYGGNCARGGNCANAARGTNGARTTYAAR

SEQ ID NO: 637 - protein, 321 aa, Homo Sapiens
GAYATHCARATGCANCARWSNCCNWSNWSNYTNWSNGCNWSNGTNGGNGAYMGNGTNCANATHCANTGYMGNGCNWSNCARWSNATHWSNCANTAYYTNAAYTGGTAYCARCARAARCCNGGNAARGCNCCNAARTTYYTNATHTAYGCNGCNWSNWSNYTNCARWSNGGNGTNCCNWSNMGNTTYWSNGGNWSNGGNWSNGGNCANGAYTTYCANYTNCANATHWSNWSNYTNCARCCNGARGAYTTYGCNGCNTAYTAYTGYCARCARWSNCAYWSNGCNCCNTTYCANTTYGGNCCNGGNCANAARGTNGAYATHAAR

SEQ ID NO: 638 - protein, 318 aa, Homo Sapiens
GAYATHCARATGCANCARWSNCCNWSNWSNYTNWSNGCNWSNYTNGGNGAYMGNGTNCANATHCANTGYMGNGCNWSNCARCANATHWSNATHTAYYTNAAYTGGTAYCARCARAARCCNGGNAARGCNCCNAARYTNYTNATHTAYGCNGCNWSNWSNYTNCARWSNGGNGTNCCNWSNMGNTTYWSNGGNWSNGGNWSNGGNCANGAYTTYCANYTNCANATHWSNWSNYTNCARCCNGARGAYTTYGCNCANTAYTAYTGYCARCARWSNTAYWSNCANYTNCANTTYGGNGGNGGNCANAARGTNGARATHAAR

SEQ ID NO: 639 - protein, 321 aa, Homo Sapiens
GAYATHCARATGCANCARWSNCCNWSNWSNYTNWSNGCNWSNGTNGGNGAYMGNGTNCANATHCANTGYMGNGCNWSNCARWSNATHMGNWSNTAYYTNAAYTGGTAYCARCARMGNCCNGGNAAYGCNCCNAARYTNYTNATHTAYGCNGCNWSNWSNYTNCARWSNGGNGTNCCNWSNMGNGTNWSNGGNWSNGGNWSNGGNCANGAYTTYCANYTNCANATHMGNWSNYTNCARCCNGARGAYTTYGCNCANTAYTAYTGYCARCARWSNTAYWSNATHCCNYTNCANTTYGGNGGNGGNCANAARGTNGARATHAAR

SEQ ID NO: 640 - protein, 321 aa, Homo Sapiens
GAYATHCARATGCANCARWSNCCNWSNWSNMGNWSNGCNWSNGTNGGNGAYMGNGTNCANATHCANTGYMGNGCNWSNCARCANATHWSNMGNTAYYTNAAYTGGTAYCARCARAARCCNGGNAARGCNCCNAARYTNYTNATHTAYGCNGCNWSNCANYTNCARWSNGGNGTNCCNWSNMGNTTYWSNGGNWSNGGNWSNGGNCANGAYTTYCANYTNCANYTNWSNWSNYTNCARCCNGARGAYTTYGCNCANTAYTAYTGYCARCARATHTAYWSNCANWSNATHCANTTYGGNCARGGNCANMGNYTNGARATHAAR

SEQ ID NO: 641 - protein, 321 aa, Homo Sapiens
GAYATHCARATGCANCARWSNCCNWSNWSNYTNWSNGCNWSNGTNGGNGAYMGNGTNCANATHCANTGYMGNGCNWSNCARMGNATHWSNWSNTAYYTNAAYTGGTAYCARCARAARCCNGGNAARGCNCCNAARGTNYTNATHTAYGCNGARWSNWSNYTNCARWSNGGNGTNCCNWSNMGNTTYWSNGGNWSNGGNWSNGGNCANGAYTTYCANYTNCANATHWSNWSNYTNCARCCNGARGAYTTYGCNCANTAYTAYTGYCARCARWSNTAYATHCANCCNATHCANTTYGGNCARGGNCANMGNYTNGARATHATH

SEQ ID NO: 642 - protein, 321 aa, Homo Sapiens
GAYATHCARATGCANCARWSNCCNWSNWSNYTNWSNGCNWSNGTNGGNGAYMGNGTNCANATHCANTGYMGNGCNWSNCARWSNATHWSNMGNTAYYTNAAYTGGTAYCARCARAARCCNGGNAARGCNCCNAARYTNYTNATHTAYCANGCNWSNWSNYTNCARWSNGGNGTNCCNWSNMGNTTYWSNGGNWSNGGNWSNGGNCANGAYTTYCANYTNCANATHWSNWSNYTNCARCCNGARAAYTTYGCNCANTAYTAYTGYCARCARWSNTAYTTYCANCCNATHCANTTYGGNCARGGNCANMGNYTNGARATHAAR

SEQ ID NO: 643 - protein, 321 aa, Homo Sapiens
GAYATHCARATGCANCARWSNCCNWSNWSNYTNWSNGCNWSNGTNGGNGAYMGNGTNCANATHCANTGYMGNGCNWSNCARWSNATHWSNWSNTAYYTNAAYTGGTAYCARCARAARCCNGGNAARGCNCCNAARYTNYTNATHTAYCANGCNWSNWSNYTNCARWSNGGNGTNCCNWSNMGNTTYWSNGGNWSNGGNWSNGGNCANGAYTTYCANYTNCANTTYWSNWSNYTNCARCCNGARGAYTTYGCNCANTAYTAYTGYCARCARWSNTAYTTYWSNCCNATHCANTTYGGNCARGGNCANMGNYTNGARATHAAR

SEQ ID NO: 644 - protein, 321 aa, Homo Sapiens
GAYATHCARATGCANCARWSNCCNWSNWSNYTNWSNGCNWSNGTNGGNGAYMGNGTNCANATHCANTGYMGNGCNWSNCARWSNATHWSNWSNTAYYTNAAYTGGTAYCARCARAARCCNGGNAARGCNCCNAARYTNYTNATHTAYCANGCNWSNWSNYTNCARWSNGGNGTNCCNWSNMGNTTYWSNGGNWSNGGNWSNGGNCANGAYTTYCANYTNCANYTNWSNWSNYTNCARCCNGARGAYTTYGCNWSNTAYTAYTGYCARCARWSNTTYTAYCANCCNATHCANTTYGGNCARGGNCANMGNYTNGARATHAAR

SEQ ID NO: 645 - protein, 321 aa, Homo Sapiens
GAYATHCARATGCANCARWSNCCNWSNWSNYTNWSNGCNWSNGTNGGNGAYMGNGTNCANATHCANTGYMGNGCNWSNCARWSNATHWSNWSNTAYYTNAAYTGGTAYCARCARAARCCNGGNAARGCNCCNAARYTNYTNATHTAYCANGTNWSNWSNYTNCARWSNGGNGTNCCNWSNMGNTTYWSNGGNWSNGGNWSNGGNCANGAYTTYCANYTNCANATHWSNWSNYTNCARCCNGARGAYTTYGCNCANTAYTAYTGYCARCARWSNTAYTTYCANCCNATHCANTTYGGNCARGGNCANMGNYTNGARATHAAR

SEQ ID NO: 646 - protein, 321 aa, Homo Sapiens
GAYATHCARATGCANCARWSNCCNWSNWSNYTNWSNGCNWSNGTNGGNGAYMGNGTNCANATHCANTGYMGNGCNWSNCARWSNATHWSNWSNTAYYTNAAYTGGTAYCARCARAARCCNGGNAARGCNCCNAARYTNYTNATHTAYCANGCNWSNWSNYTNCARWSNGGNGTNCCNWSNMGNTTYWSNGGNWSNGGNWSNGGNCANGAYTTYCANYTNCANATHWSNWSNYTNCARCCNGARGAYTTYGCNWSNTAYTAYTGYCARCARWSNTTYTAYGCNCCNATHCANTTYGGNCARGGNCANMGNYTNGARATHAAR

SEQ ID NO: 647 - protein, 321 aa, Homo Sapiens
GAYATHCARATGCANCARWSNCCNWSNWSNYTNWSNGCNWSNGTNGGNGAYMGNGTNCANATHCANTGYMGNGCNWSNCARWSNATHWSNWSNTAYYTNAAYTGGTAYCARCARAARCCNGGNAARGCNCCNAARYTNYTNATHTAYCANGCNWSNWSNYTNCARWSNGGNGTNCCNWSNMGNTTYWSNGGNWSNGGNWSNGGNCANGAYTTYCANYTNCANATHWSNWSNYTNCARCCNGARGAYTTYGCNCANTAYTAYTGYCARCARWSNTAYTTYCANCCNATHCANTTYGGNCARGGNCANMGNYTNGARATHAAR

SEQ ID NO: 648 - protein, 321 aa, Homo Sapiens
GAYATHCARATGCANCARWSNCCNWSNWSNYTNWSNGCNWSNGTNGGNGAYMGNGTNCANATHCANTGYCARGCNWSNCARGAYATHWSNAAYTAYYTNAAYTGGTAYCARCARAARCCNGGNAARGCNCCNAARYTNYTNATHTAYGAYGCNWSNAAYYTNGARCANGGNGTNCCNWSNMGNTTYWSNGGNWSNGGNWSNGGNCANGAYTTYCANTTYCANATHWSNWSNYTNCARCCNGARGAYATHGCNCANTAYTAYTGYCARCARTAYGAYTAYYTNCCNTTYCANTTYGGNCCNGGNCANAARGTNGAYATHAAR

SEQ ID NO: 649 - protein, 321 aa, Homo Sapiens
GAYATHCARATGCANCARWSNCCNWSNWSNYTNWSNGCNWSNGTNGGNGAYMGNGTNCANATHCANTGYCARGCNWSNCARGAYATHWSNAAYWSNYTNAAYTGGTAYCARCARAARCCNGGNAARGCNCCNGARYTNYTNATHTAYGAYGCNWSNAAYYTNGARCANGGNGTNCCNWSNMGNTTYWSNGGNWSNGGNWSNGGNCANGAYTTYCANTTYCANATHWSNWSNYTNCARCCNGARGAYATHGCNCANTAYTAYTGYCARCARTGYGAYGAYYTNCCNYTNCANTTYGGNGGNGGNCANAARGTNGARATHAAR

SEQ ID NO: 650 - protein, 321 aa, Homo Sapiens
GAYATHCARATGCANCARWSNCCNWSNWSNYTNWSNGCNWSNGTNGGNGAYMGNGTNCANATHCANTGYCARGCNWSNCARGAYATHWSNGAYTAYYTNAAYTGGTAYCARCARAARCCNGGNAARGCNCCNAARYTNYTNATHTAYGAYGCNWSNAAYYTNGARCANGGNGTNCCNWSNMGNTTYWSNGGNWSNGGNWSNGGNCANGAYTTYCANTTYCANATHWSNWSNYTNCARCCNGARGAYATHGCNCANTAYTAYTGYCARCAYTAYGAYAAYYTNCCNYTNCANTTYGGNGGNGGNCANAARGTNGARATHAAR

SEQ ID NO: 651 - protein, 321 aa, Homo Sapiens
GAYATHCARATGCANCARWSNCCNWSNWSNYTNWSNGCNWSNGTNGGNGAYMGNGTNGCNATHCANTGYCARGCNWSNCARGAYATHWSNAAYTAYYTNAAYTGGTAYCARCARAARCCNGGNAARGCNCCNAARYTNYTNATHTAYGAYGCNWSNAAYYTNGARCANGGNGTNCCNWSNMGNTTYWSNGGNWSNGGNWSNGGNCANGAYTTYCANTTYCANATHWSNWSNYTNCARCCNGARGAYATHGCNCANTAYTAYTGYCARCARTAYGAYAAYYTNCCNYTNCANTTYGGNGGNGGNCANAARGTNGARATHAAR

SEQ ID NO: 652 - protein, 321 aa, Homo Sapiens
GAYATHCARATGCANCARWSNCCNWSNWSNYTNWSNGCNWSNGTNGGNGAYMGNGTNCANATHCANTGYCARGCNWSNCARGAYATHWSNAAYWSNYTNAAYTGGTAYCARCARAARCCNGGNAARGCNCCNAARYTNYTNATHTAYGAYGCNWSNATHYTNGARCANGGNGTNCCNWSNMGNTTYWSNGGNWSNGGNWSNGARCANGAYTTYCANTTYCANATHWSNWSNYTNCARCCNGARGAYATHGCNCANTAYTAYTGYCARCARTGYGAYATHYTNCCNYTNWSNTTYGGNGGNGGNCANAARGTNGARATHAAR

SEQ ID NO: 653 - protein, 321 aa, Homo Sapiens
GAYATHCARATGCANCARWSNCCNWSNWSNYTNWSNGCNWSNGTNGGNGAYMGNGTNCANATHCANTGYCARGCNWSNCARGAYATHWSNAAYWSNYTNAAYTGGTAYCARCARAARCCNGGNAARGCNCCNAARYTNYTNATHTAYGAYGCNWSNAAYYTNGARCANGGNGTNCCNWSNMGNTTYWSNGGNWSNGGNWSNGGNCANGAYTTYCANTTYCANATHWSNWSNYTNCARCCNGARGAYATHGCNCANTAYTAYTGYCARCARTAYGAYAAYYTNCCNYTNGCNTTYGGNGGNGGNCANAARGTNGARATHMGN

SEQ ID NO: 654 - protein, 321 aa, Homo Sapiens
GAYATHCARATGCANCARWSNCCNWSNWSNYTNWSNGCNWSNGTNGGNGAYGGNGTNCANATHCANTGYCARGCNWSNCARGAYATHCANAAYTAYYTNAAYTGGTAYCARCARAARCCNGGNAARGCNCCNAARYTNYTNATHTAYGAYGCNWSNAAYYTNGARCANGGNGTNCCNWSNMGNTTYWSNGGNWSNGGNWSNGGNCANGAYTTYCANTTYCANATHWSNWSNYTNCARCCNGARGAYATHGCNCANTAYTAYTGYCARCARTAYGAYWSNYTNCCNATHCANTTYGGNCARGGNCANMGNYTNGARATHAAR

SEQ ID NO: 655 - protein, 321 aa, Homo Sapiens
GAYATHCARATGCANCARWSNCCNWSNWSNYTNWSNGCNWSNGTNGGNGAYMGNGTNCANATHCANTGYCARGCNWSNCARGAYATHWSNAAYTAYYTNAAYTGGTAYCARCARAARYTNGGNAARGCNCCNAARYTNYTNATHCAYGAYGCNWSNAAYYTNGARCANGGNGTNCCNWSNMGNTTYWSNGGNWSNGGNWSNGGNCANGAYTTYCANTTYCANATHWSNWSNYTNCARCCNGARGAYATHGCNCANTAYTAYTGYCARCARTAYGAYAAYYTNCCNATHCANTTYGGNCARGGNCANMGNYTNGARATHAAR

SEQ ID NO: 656 - protein, 321 aa, Homo Sapiens
GAYATHCARATGCANCARWSNCCNWSNWSNYTNWSNGCNWSNGTNGGNGAYMGNGTNCANATHCANTGYCARGCNWSNCARGAYATHWSNGAYTAYYTNAAYTGGTAYCARCARAARCCNGGNAARGCNCCNAARYTNYTNATHTAYGAYGCNWSNAAYYTNGARCANGGNGTNCCNWSNMGNTTYWSNGGNWSNGGNWSNGGNCANGAYTTYCANTTYCANATHWSNWSNYTNCARCCNGARGAYATHGCNCANTAYTAYTGYCARCAYTAYGAYAAYYTNCCNATHCANTTYGGNCARGGNCANMGNYTNGARATHAAR

SEQ ID NO: 657 - protein, 321 aa, Homo Sapiens
GAYATHCARATGCANCARWSNCCNWSNWSNYTNWSNGCNWSNGTNGGNGAYMGNGTNCANATHCANTGYCARGCNWSNCARGAYATHWSNAAYWSNYTNAAYTGGTAYCARCARAARCCNGGNAARGCNCCNAARYTNYTNATHTAYGAYGCNWSNAAYYTNGARCANGGNGTNCCNWSNMGNTTYWSNGGNWSNGGNWSNGGNCANGAYTTYCANTTYCANATHWSNWSNYTNCARCCNGARGAYATHGCNCANTAYTAYTGYCARCAYTAYGAYAAYYTNCCNATHCANTTYGGNCARGGNCANMGNYTNGARATHAAR

SEQ ID NO: 658 - protein, 360 aa, Homo Sapiens
CARGTNCARYTNGTNCARWSNGGNGCNGARGTNAARAARCCNGGNGCNWSNGTNAARGTNWSNTGYAARGCNWSNGGNTAYCANTTYCANWSNTAYGGNATHWSNTGGGTNMGNCARGCNCCNGGNCARGGNYTNGARTGGATGGGNTGGATHWSNGCNWSNAAYGGNAAYCANAAYTAYGCNCARAARYTNCARGAYMGNGTNCANATGCANCANGAYCANWSNCANWSNCANGCNTAYATGGARYTNMGNWSNYTNMGNWSNGAYGAYCANGCNGTNTAYTAYTGYGCNMGNGARGAYAAYTGGAAYTAYGGNTTYTTYGAYTAYTGGGGNCARGGNCANYTNGTNCANGTNWSNWSN

SEQ ID NO: 659 - protein, 351 aa, Homo Sapiens
CARGTNCAYYTNGTNCARWSNGGNGCNGARGTNAARAARCCNGGNGCNWSNGTNAARGTNWSNTGYAARGTNWSNGGNTAYCANTTYCANGGNCAYTAYATGCAYTGGGTNMGNCARGCNCCNGGNCARGGNYTNGARTGGATGGGNTGGATHAAYCCNAAYWSNGGNGGNCANAAYTGYGCNCARAARTTYCARGGNMGNGTNCANATGCANMGNGAYCANWSNATHWSNCANGCNTAYATGGARYTNWSNMGNYTNMGNWSNGAYGAYCANGCNGTNTAYTAYTGYGCNMGNWSNATHGCNGTNGCNYTNGAYTAYTGGGGNCARGGNCANYTNGTNCANGTNWSNWSN

SEQ ID NO: 660 - protein, 351 aa, Homo Sapiens
CARGTNCARYTNGTNCARWSNGGNGCNGARGTNAARAARCCNGGNGCNWSNGTNAARGTNWSNTGYAARGCNWSNGGNTAYCANTTYCANGGNTAYTAYATGCAYTGGGTNMGNCARGCNCCNGGNCARGGNYTNGARTGGATGGGNTGGATHAAYCCNAAYWSNGGNGGNCANAAYCAYCANCARAARTTYCARGGNMGNGTNCANATGCANMGNGAYCANWSNATHWSNCANGCNTAYATGGARYTNWSNMGNYTNMGNWSNGAYGAYCANGCNGTNTAYTAYTGYGCNMGNWSNATHGCNGTNGCNYTNGAYTAYTGGGGNCARGGNCANYTNGTNCANGTNWSNWSN

SEQ ID NO: 661 - protein, 366 aa, Homo Sapiens
CARGTNCARYTNGTNCARWSNGGNGCNGARGTNMGNAARCCNGGNGCNWSNGTNAARGTNWSNTGYAARGTNWSNGGNTAYCANYTNCANGARYTNWSNATGCAYTGGGTNMGNCARGCNCCNGGNAARGGNYTNGARTGGATGGGNWSNTTYGAYCCNGARGAYGGNGARCANATHTAYGCNCARAARTTYCARGGNMGNGTNCANATGYTNGARGAYCANWSNCANGAYCANGCNTAYATGGARYTNWSNWSNYTNMGNWSNGARGAYCANGCNGTNTAYTAYTGYGCNCANGARGGNGAYGGNGGNTAYTAYTAYTAYGGNATGGAYGTNTGGGGNCARGGNCANCANGTNCANGTNWSNWSN

SEQ ID NO: 662 - protein, 366 aa, Homo Sapiens
CARGTNCANYTNAARGARWSNGGNCCNGTNYTNGTNAARCCNCANGARCANYTNCANYTNCANTGYCANGTNWSNGGNTTYWSNYTNWSNAAYGCNMGNATGGGNGTNWSNTGGATHMGNCARCCNCCNGGNAARGCNYTNGARTGGYTNGCNCAYATHTTYWSNAAYGAYGARAARWSNTAYWSNCANWSNYTNAARWSNMGNYTNCANATHWSNAARGAYCANWSNAARWSNCARGTNGTNYTNCANATGCANAAYATGGAYCCNGTNGAYCANGCNCANTAYTAYTGYGCNMGNATGTAYWSNWSNGGNTGGTAYGGNGTNTTYGAYTAYTGGGGNCARGGNCANYTNGTNCANGTNWSNWSN

SEQ ID NO: 663 - protein, 369 aa, Homo Sapiens
CARGTNCANYTNAARGARWSNGGNCCNGTNYTNGTNAARCCNCANGARCANYTNCANYTNCANTGYCANGTNWSNGGNTTYWSNYTNWSNAAYGCNMGNATGGGNGTNWSNTGGATHMGNCARCCNCCNGGNAARGCNYTNGARTGGYTNGTNYTNATHTTYWSNAAYGAYGARAARWSNTAYWSNCANWSNYTNAARWSNMGNYTNCANATHWSNAARGAYCANWSNAARWSNCARGTNGTNYTNCANATGCANAAYATGGAYCCNGTNGAYCANGCNCANTAYTAYTGYGCNMGNGTNTAYWSNWSNGGNTGGWSNTTYTAYGGNATGGAYGTNTGGGGNCARGGNCANCANGTNCANGTNWSNWSN

SEQ ID NO: 664 - protein, 354 aa, Homo Sapiens
CARATHCANYTNAARGARWSNGGNCCNCANYTNGTNAARCCNCANCARCANYTNCANYTNCANTGYCANTTYWSNGGNTTYWSNYTNWSNCANGGNGGNGTNGGNGTNGGNTGGATHMGNCARCCNCCNGGNAARGCNYTNGARTGGYTNGCNYTNATHTAYTGGAAYGAYGAYAARMGNTAYWSNCCNWSNYTNAARWSNMGNYTNCANATHCANAARGAYCANWSNAARAAYCARGTNGTNYTNCANATGCANAAYATGGAYCCNGTNGAYCANGCNCANTAYTAYTGYGCNCAYMGNMGNGARYTNCCNTTYGAYTAYTGGGGNCARGGNCANYTNGTNCANGTNWSNWSN

SEQ ID NO: 665 - protein, 354 aa, Homo Sapiens
CARATHCANYTNAARGARWSNGGNCCNCANYTNGTNAARCCNCANCARCANYTNCANYTNCANTGYCANTTYWSNGGNTTYWSNYTNWSNCANGGNGGNGTNGGNGTNGGNTGGATHMGNCARCCNCCNGGNAARGCNYTNGARTGGYTNGCNYTNATHTAYTGGAAYGAYGAYAARMGNTAYWSNCCNWSNYTNAARWSNMGNYTNCANATHCANAARGAYCANWSNAARCANCARGTNGTNYTNCANGTNCANGAYATGGAYCCNGTNGAYCANGCNCANTAYTAYTGYGCNCAYMGNAAYTGGCANCCNTTYGAYTAYTGGGGNCARGGNCANYTNGTNCANGTNWSNWSN

SEQ ID NO: 666 - protein, 354 aa, Homo Sapiens
CARATHCANYTNAARGARWSNGGNCCNCANYTNGTNAARCCNCANCARCANYTNCANYTNCANTGYCANTTYWSNGGNTTYWSNYTNAAYCANGGNGGNGTNGGNGTNGGNTGGATHMGNCARCCNCCNGGNAARGCNYTNGARTGGYTNGCNYTNATHTAYTGGAAYGAYGAYAARMGNTAYWSNCCNWSNYTNAARWSNMGNYTNCANATHCANAARGAYCANWSNAARAAYCARGTNGTNYTNCANATGCANAAYATGGAYCCNGTNGAYCANGCNCANTAYTAYTGYGCNCAYMGNYTNGARYTNCCNTTYGAYTAYTGGGGNCARGGNCANYTNGTNCANGTNWSNWSN

SEQ ID NO: 667 - protein, 354 aa, Homo Sapiens
CARATHCANYTNAARGARWSNGGNCCNCANYTNGTNAARCCNCANCARCANYTNCANYTNCANTGYCANTTYWSNGGNTTYWSNYTNWSNCANGGNGGNGTNGGNGTNGGNTGGATHMGNCARCCNCCNGGNAARGCNYTNGARTGGYTNGCNYTNATHTAYTGGAAYGAYGAYAARMGNTAYWSNCCNWSNYTNAARWSNMGNYTNCANATHCANAARGAYCANWSNAARAAYCARGTNGTNYTNCANATGCANAAYYTNGAYCCNGTNGAYCANGCNCANTAYTAYTGYGCNCAYMGNMGNGARGTNCCNTTYGAYTAYTGGGGNCARGGNCANYTNGTNCANGTNWSNWSN

SEQ ID NO: 668 - protein, 354 aa, Homo Sapiens
CARATHCANYTNAARGARWSNGGNCCNCANYTNGTNAARCCNCANCARCANYTNCANYTNCANTGYCANTTYWSNGGNTTYWSNYTNWSNCANGGNGGNGTNGGNGTNGGNTGGATHMGNCARCCNCCNGGNAARGCNYTNGARTGGYTNGCNYTNATHTAYTGGAAYGTNGARAARMGNTAYWSNCCNWSNYTNMGNWSNMGNYTNCANATHCANAARGCNCANWSNAARAAYCARGTNGTNYTNCANATGCANAAYATGGAYCCNGTNGAYCANGCNCANTAYTAYTGYGCNCAYMGNCAYCANAAYCCNTTYGARTAYTGGGGNCARGGNCANYTNGTNCANGTNWSNWSN

SEQ ID NO: 669 - protein, 354 aa, Homo Sapiens
CARATHCANYTNAARGARWSNGGNCCNCANYTNGTNAARCCNCANCARCANYTNCANYTNCANTGYCANTTYWSNGGNTTYWSNYTNWSNCANGGNGGNGTNGGNGTNGGNTGGATHMGNCARCCNCCNGGNAARGCNYTNGARTGGYTNGCNYTNATHTAYTGGAAYGAYGAYAARMGNTAYWSNCCNWSNYTNAARWSNMGNYTNCANATHCANAARGAYCANWSNAARAAYCARGTNGTNYTNCANATGCANAAYATGGAYCCNGTNGAYCANGCNCANTAYTAYTGYGCNCAYMGNGGNGARYTNCCNTTYGAYTAYTGGGGNCARGGNCANYTNGTNCANGTNWSNWSN

SEQ ID NO: 670 - protein, 363 aa, Homo Sapiens
GARGTNCARYTNGTNGARWSNGGNGGNGGNYTNGTNAARCCNGGNGGNWSNYTNMGNYTNWSNTGYGCNGCNWSNGGNTTYCCNTTYWSNMGNTAYWSNATGAAYTGGGTNMGNCARGCNCCNGGNAARGGNYTNGARTGGGTNWSNGCNATHWSNWSNWSNWSNWSNTAYATHTAYTAYGCNGAYWSNGTNAARGGNMGNTTYCANATHWSNMGNGAYAAYGCNAARAAYWSNYTNTAYYTNCARATGAAYWSNYTNMGNGCNGARGAYCANGCNGTNTAYTAYTGYGCNMGNGAYMGNGTNGGNGCNCANCCNGAYGCNTTYGAYATHTGGGGNCARGGNCANATGGTNCANGTNWSNWSN

SEQ ID NO: 671 - protein, 384 aa, Homo Sapiens
GARGTNCARYTNYTNGARWSNGGNGGNGGNYTNGTNCARCCNGGNGGNWSNYTNMGNYTNWSNTGYGCNGCNWSNGGNTTYCANTTYWSNWSNTAYGCNATGAAYTGGGTNMGNCARGCNCCNGGNAARGGNYTNGARTGGGTNWSNGCNATHWSNGGNWSNGGNGGNWSNCANTAYTAYGCNGAYWSNGTNAARGGNMGNTTYCANATHWSNMGNGAYAAYWSNAARAAYCANYTNTAYYTNCARATGAAYWSNYTNMGNGCNGARGAYCANGCNGTNTAYTAYTGYGCNAARGARGGNATHGCNGTNGCNGGNCANGCNGARTAYTAYTAYTAYTAYGCNATGGAYGTNTGGGGNCARGGNCANCANGTNCANGTNWSNWSN

SEQ ID NO: 672 - protein, 375 aa, Homo Sapiens
GARGTNCARYTNYTNGARWSNGGNGGNGGNYTNGTNCARCCNGGNGGNWSNYTNMGNYTNWSNTGYGCNGCNWSNGGNTTYCANTTYWSNWSNTAYGCNATGWSNTGGGTNMGNCARGCNCCNGGNAARGGNYTNGARTGGGTNWSNGCNATHWSNGGNWSNGGNGGNWSNCANTAYTAYGCNGAYWSNGTNAARGGNMGNTTYCANATHWSNMGNGAYAAYWSNAARAAYCANYTNTAYYTNCARATGAAYWSNYTNMGNGCNGARGAYCANGCNGTNTAYTAYTGYGCNAARGARGGNATHGCNGCNMGNGAYWSNTAYTAYTAYTAYGCNATGGAYGTNTGGGGNCARGGNCANCANGTNCANGTNWSNWSN

SEQ ID NO: 673 - protein, 375 aa, Homo Sapiens
GARGTNCARYTNYTNGARWSNGGNGGNGGNYTNGTNCARCCNGGNGGNWSNYTNMGNYTNWSNTGYCANGCNWSNGGNTTYCANTTYWSNWSNTAYGCNATGWSNTGGGTNMGNCARGCNCCNGGNAARGGNYTNGARTGGGTNWSNGCNATHWSNGGNWSNGGNGGNWSNCANTAYTAYGCNGAYWSNGTNAARGGNMGNTTYCANATHWSNMGNGAYAAYWSNAARAAYCANYTNTAYYTNCARATGAAYWSNYTNMGNGCNGARGAYCANGCNGARTAYTAYTGYGCNAARGARGGNATHGCNGGNMGNGAYWSNTAYTAYTAYTAYGGNATGGAYGTNTGGGGNCARGGNCANCANGTNCANGTNWSNWSN

SEQ ID NO: 674 - protein, 369 aa, Homo Sapiens
CARGTNCARYTNGTNGARWSNGGNGGNGGNGTNGTNCARCCNGGNMGNWSNYTNMGNYTNWSNTGYGCNGCNWSNGGNTTYCANTTYWSNWSNTAYGGNATGCAYTGGGTNMGNCARGCNCCNGGNAARGGNYTNGARTGGGTNGCNTTYATHWSNGAYGAYGGNWSNCANAARTAYTAYGCNGAYWSNGTNAARGGNMGNTTYCANATHWSNMGNGAYAAYWSNATGAAYCANYTNTAYYTNCARATGAAYWSNYTNMGNGCNGARGAYCANGCNGTNTAYTAYTGYGCNMGNWSNTAYTAYGAYWSNWSNGGNTAYTAYTAYGGNTTYGAYTAYTGGGGNCARGGNCANYTNGTNCANGTNWSNWSN

SEQ ID NO: 675 - protein, 342 aa, Homo Sapiens
CARGTNCARYTNGTNGARWSNGGNGGNGGNGTNGTNCARCCNGGNMGNWSNYTNMGNYTNWSNTGYGCNGCNWSNGGNTTYCANTTYWSNWSNTAYGGNATGCAYTGGGTNMGNCARGCNCCNGGNAARGGNYTNGARTGGGTNGCNGTNATHTGGTAYGAYGGNWSNAAYAARTAYTAYGCNGAYWSNGTNAARGGNMGNTTYCANATHWSNMGNGAYAAYWSNAARAAYCANYTNTAYYTNCARATGAAYWSNYTNMGNGCNGARGAYCANGCNGTNTAYTAYTGYGCNMGNAAYGTNATHGAYTAYTGGGGNCARGGNCANYTNGTNCANGTNWSNWSN

SEQ ID NO: 676 - protein, 360 aa, Homo Sapiens
CARGTNCARYTNGTNGARWSNGGNGGNGGNGTNGTNCARCCNGGNMGNWSNYTNMGNYTNWSNTGYGCNGCNWSNGGNTTYCANTTYWSNWSNTAYGAYATGCAYTGGGTNMGNCARGCNCCNGGNAARGGNYTNGARTGGGTNGCNGTNATHTGGTAYGAYGGNWSNATHAARTAYTAYGCNGAYWSNGTNAARGGNMGNTTYCANATHWSNMGNGAYAAYWSNAARAAYCANYTNTAYYTNCARATGAAYWSNYTNMGNGCNGARGAYCANGCNGTNTAYTAYTGYGCNMGNGGNGGNGCNCANGGNGCNGARTAYTTYCARCAYTGGGGNCARGGNCANYTNGTNCANGTNWSNWSN

SEQ ID NO: 677 - protein, 354 aa, Homo Sapiens
CARGTNCARYTNGTNGARWSNGGNGGNGGNGTNGTNCARCCNGGNMGNWSNYTNMGNYTNWSNTGYGCNGCNWSNGGNTTYCANTTYWSNWSNTAYGGNATGCAYTGGGTNMGNCARGCNCCNGGNAARGGNYTNGARTGGGTNGCNGTNATHTGGTAYGAYGGNWSNAAYAARTAYTAYGCNGAYWSNGTNAARGGNMGNTTYCANATHWSNMGNGAYAAYWSNAARAAYCANYTNTAYYTNCARATGAAYWSNYTNMGNGCNGARGAYCANGCNGTNTAYTAYTGYGTNYTNYTNTGGTTYGGNGARCANTTYGAYTAYTGGGGNCARGGNWSNYTNGTNCANGTNWSNCCN

SEQ ID NO: 678 - protein, 345 aa, Homo Sapiens
CARGTNCARYTNGTNGARWSNGGNGGNGGNGTNGTNCARCCNGGNMGNWSNYTNMGNYTNWSNTGYGCNGCNWSNGGNTTYCANTTYWSNWSNTAYGGNATGCAYTGGGTNMGNCARGCNCCNGGNAARGGNYTNGARTGGGTNGCNGTNATHTGGWSNGAYGGNWSNAAYAARTAYTAYGCNGAYWSNGTNAARGGNMGNTTYCANATHWSNMGNGAYAAYWSNAARAAYCANYTNTAYYTNCARATGAAYWSNYTNMGNGCNGARGAYCANGCNGTNTAYTAYTGYGCNMGNAAYYTNCCNTTYGAYTAYTGGGGNCARGGNCANYTNGTNCANGTNWSNWSN

SEQ ID NO: 679 - protein, 369 aa, Homo Sapiens
CARGTNCARYTNGTNGARWSNGGNGGNGGNGTNGTNCARCCNGGNMGNWSNYTNMGNYTNWSNTGYGCNGCNWSNGGNTTYCANTTYWSNWSNTAYGGNATGCAYTGGGTNMGNCARGCNCCNGGNAARGGNYTNGARTGGGTNGCNGTNATHTGGGAYGAYGGNWSNAAYCARTAYTAYCANGAYWSNGTNAARGGNMGNTTYCANGTNWSNMGNGAYAAYWSNAARAAYCANYTNTTYYTNCARATGAAYWSNYTNMGNGCNGARGAYCANGCNGTNTAYTAYTGYGCNMGNWSNCAYTAYGGNGGNGAYTAYGAYTAYTAYGGNATGGAYGTNTGGGGNCARGGNCANCANGTNCANGTNWSNWSN

SEQ ID NO: 680 - protein, 360 aa, Homo Sapiens
CARGTNCARYTNGTNGARWSNGGNGGNGGNGTNGTNCARCCNGGNMGNWSNYTNMGNYTNWSNTGYGCNGCNWSNGGNTTYCANTTYWSNWSNTAYGGNATGCAYTGGGTNMGNCARGCNCCNGGNAARGGNYTNGARTGGGTNGCNGTNATHTGGTAYGAYGGNWSNAAYAARMGNTAYGTNGAYWSNGTNAARGGNMGNTTYCANATHWSNMGNGAYAAYWSNAARAAYCANYTNTAYYTNCARATGAAYWSNYTNMGNGCNGARGAYCANGCNGTNTAYTAYTGYGCNMGNGAYGGNTGGCARCARCARGCNCCNTTYGAYTAYTGGGGNCARGGNCANYTNGTNCANGTNWSNWSN

SEQ ID NO: 681 - protein, 354 aa, Homo Sapiens
CARGTNCARYTNGTNGARWSNGGNGGNGGNGTNGTNCARCCNGGNMGNWSNYTNMGNYTNWSNTGYGCNGCNWSNGGNTTYCANTTYMGNWSNCAYGGNATGCAYTGGGTNMGNCARGCNCCNGGNAARGGNYTNGARTGGGTNGCNGTNATHTGGTAYGAYGGNWSNAAYAARAAYTAYGCNGAYWSNGTNMGNGGNMGNTTYCANATHWSNMGNGAYAAYWSNAARAAYCANYTNGAYYTNCARATGAAYWSNYTNMGNGCNGARGAYCANGCNGTNTAYTAYTGYGCNMGNTGGGGNATHWSNGCNCCNTTYGAYTGYTGGGGNCARGGNCANYTNGTNCANGTNWSNWSN

SEQ ID NO: 682 - protein, 345 aa, Homo Sapiens
GARGTNCARYTNGTNGARWSNGGNGGNGGNYTNGTNCARCCNGGNGGNWSNYTNMGNYTNWSNTGYGCNGCNWSNGGNTTYCANTTYWSNGCNTAYWSNATGAAYTGGGTNMGNCARGCNCCNGGNAARGGNYTNGARTGGGTNWSNTAYATHWSNWSNWSNGGNMGNCANATHTAYTAYGCNGAYWSNGTNAARGGNMGNTTYCANATHWSNMGNGAYAAYGCNAARAAYWSNYTNTTYYTNCARATGAAYWSNYTNMGNGAYGARGAYCANGCNGTNTAYTAYTGYGCNYTNTGGGCNCCNTTYGAYTAYTGGGGNCARGGNCANYTNGTNCANGTNWSNWSN

SEQ ID NO: 683 - protein, 375 aa, Homo Sapiens
GARGTNCARYTNGTNGARWSNGGNGGNGGNYTNGTNCARCCNGGNGGNWSNYTNMGNYTNWSNTGYGCNGCNWSNGGNTTYCANTTYWSNWSNTAYWSNATGAAYTGGGTNMGNCARGCNCCNGGNAARGGNYTNGARTGGGTNWSNCAYATHWSNWSNWSNWSNMGNCANATHTAYTAYGCNGAYWSNGTNAARGGNMGNTTYCANATHWSNMGNGAYAAYGCNAARAAYWSNGTNTAYYTNCARATGAAYWSNYTNMGNGAYGARGAYCANGCNGTNTAYTAYTGYGCNMGNGAYGGNTAYAAYTGGAAYGGNGGNGGNAAYTAYTAYGGNATGGAYGTNTGGGGNCARGGNCANCANGTNCANGTNWSNWSN

SEQ ID NO: 684 - protein, 375 aa, Homo Sapiens
GARGTNCARYTNGTNGARWSNGGNGGNGGNYTNGTNCARCCNGGNGGNWSNYTNMGNYTNWSNTGYGCNGCNWSNGGNTTYCANTTYWSNWSNTAYWSNATGAAYTGGGTNMGNCARGCNCCNGGNAARGGNYTNGARTGGGTNWSNCAYATHWSNMGNWSNWSNMGNCANATHTAYTAYGCNGAYWSNGTNAARGGNMGNTTYCANATHWSNMGNGAYAAYGCNAARAAYWSNYTNTAYYTNCARATGAAYWSNYTNMGNGAYGARGAYCANGCNGTNTAYTAYTGYGCNMGNGAYGGNTAYAAYTGGAAYAAYGGNGGNTAYTAYTAYGGNATGGAYGTNTGGGGNCARGGNCANCANGTNCANGTNWSNWSN

SEQ ID NO: 685 - protein, 354 aa, Homo Sapiens
CARGTNCARYTNCARGARWSNGGNCCNGGNYTNGTNAARCCNWSNCARCANYTNWSNYTNCANTGYCANGTNWSNGGNGGNWSNGTNWSNWSNGGNGGNTAYTAYTGGWSNTGGATHMGNCARCAYCCNGGNAARGGNYTNGARTGGATHGGNTAYATHCAYWSNWSNGGNWSNCANTAYTAYAAYCCNWSNYTNAARWSNMGNGTNCANATHWSNGTNGAYCANWSNAARAAYCARTTYWSNYTNAAYYTNWSNWSNGTNCANGCNGCNGAYCANGCNGTNTAYTAYTGYGCNMGNGGNCCNTAYTAYGGNATGGAYGTNTGGGGNCARGGNCANCANGTNCANGTNWSNWSN

SEQ ID NO: 686 - protein, 381 aa, Homo Sapiens
CARGTNCARYTNCARGARWSNGGNCCNGGNYTNGTNAARCCNWSNCARCANYTNWSNYTNCANTGYCANGTNWSNGGNGGNWSNATHWSNMGNGGNGGNTAYTAYTGGWSNTGGATHMGNCARCAYCCNGGNAARGGNYTNGARTGGATHGGNTAYATHTAYCAYWSNGGNWSNCANTAYTAYAAYCCNWSNYTNAARWSNMGNGTNAAYATGWSNGTNGAYCANWSNAARAAYCARTTYWSNYTNAARYTNWSNWSNGTNCANGCNGCNGAYCANGCNGTNTAYTAYTGYGCNMGNGCNYTNMGNGGNATHGTNYTNATGGTNTAYGTNYTNGGNGCNYTNGAYATHTGGGGNCARGGNCANAARGTNCANGTNWSNWSN

SEQ ID NO: 687 - protein, 381 aa, Homo Sapiens
CARGTNCARYTNCARGARWSNGGNCCNGGNYTNGTNAARCCNWSNCARCANYTNWSNYTNCANTGYCANGTNWSNGGNGGNWSNATHWSNWSNGGNGGNTAYTAYTGGWSNTGGATHMGNCARCAYCCNGGNAARGGNYTNGARTGGATHGGNTAYATHTAYTAYWSNGGNWSNCANTAYTAYAAYCCNWSNYTNAARWSNMGNGTNCANATHWSNGTNGAYCANWSNAARAAYCARTTYWSNYTNAARYTNWSNWSNGTNCANGCNGCNGAYCANGCNGTNTAYTAYTGYGCNMGNGAYGARCANGTNGTNMGNGGNYTNATHMGNTAYTGYTAYGGNATGGAYGTNTGGGGNCARGGNCANCANGTNCANGTNWSNWSN

SEQ ID NO: 688 - protein, 366 aa, Homo Sapiens
CARGTNCARYTNCARGARWSNGGNCCNGGNYTNGTNAARCCNWSNCARCANYTNWSNYTNAAYTGYCANGTNWSNGGNGGNWSNATHWSNWSNGGNGGNTAYTAYTGGWSNTGGATHMGNCARCAYCCNGGNAARGGNYTNGARTGGATHGGNTAYATHCAYTAYWSNGGNWSNCANTAYTAYAAYCCNWSNYTNAARWSNMGNATHCANATHWSNGCNGAYCANWSNAARAAYCARTTYWSNYTNAARYTNAAYWSNGTNCANGCNGCNGAYCANGCNGTNTAYTAYTGYGCNMGNGAYMGNGGNGGNGGNGAYTAYGGNMGNATGGAYGTNTGGGGNCARGGNCANCANGTNCANGTNWSNWSN

SEQ ID NO: 689 - protein, 366 aa, Homo Sapiens; identical to SEQ ID NO: 688

SEQ ID NO: 690 - protein, 357 aa, Homo Sapiens
CARGTNCARYTNCARGARWSNGGNCCNGGNYTNGTNAARCCNWSNCARCANYTNWSNYTNCANTGYCANGTNWSNGGNGGNWSNATHWSNWSNGGNGGNTAYTAYTGGWSNTGGATHMGNCARCAYCCNGGNAARGGNYTNGARTGGATHGGNTAYATHCAYWSNWSNGGNWSNCANTAYTAYAAYCCNWSNYTNAARWSNMGNATHCANAARWSNGTNGAYCANWSNAARAAYCARTTYWSNYTNAARYTNWSNWSNGTNCANGCNGCNGAYCANGCNGTNTAYTAYTGYGCNMGNWSNAAYAAYTAYGGNTGYTTYGCNYTNTGGGGNMGNGGNCANYTNGTNCANGTNWSNWSN

SEQ ID NO: 691 - protein, 357 aa, Homo Sapiens; identical to SEQ ID NO: 690

SEQ ID NO: 692 - protein, 399 aa, Homo Sapiens
CARGTNCARYTNCARGARWSNGGNCCNGGNYTNGTNAARCCNWSNCARCANYTNWSNYTNCANTGYCANGTNWSNGGNGGNWSNATHWSNWSNGGNGGNTAYTAYTGGWSNTGGATHMGNCARCAYCCNGGNAARGGNYTNGARTGGATHGGNTAYATHCAYTAYWSNGGNWSNCANTAYTAYAAYCCNWSNYTNAARWSNMGNGTNCANATHWSNGTNGAYCANWSNAARAAYCARTTYWSNYTNAARYTNWSNWSNGTNCANGCNGCNGAYCANGCNGTNTAYTAYTGYGCNWSNGGNTAYAAYTAYGGNYTNTAYTAYTAYGAYWSNWSNGGNTAYCCNWSNTAYTAYTAYGGNATGGAYGTNTGGGGNCARGGNCANCANGTNCANGTNWSNWSN

SEQ ID NO: 693 - protein, 375 aa, Homo Sapiens
CARGTNCARYTNCARGARWSNGGNCCNGGNYTNGTNAARCCNWSNCARCANYTNWSNYTNCANTGYCANGTNWSNGGNGGNWSNATHWSNWSNGGNGAYTAYTAYTGGAAYTGGGTNMGNCARCAYCCNGGNAARGGNYTNGARTGGATHGGNTAYATHTAYTAYWSNGGNGGNCANTAYTAYAAYCCNWSNYTNAARWSNMGNGTNCANATHWSNGTNGAYCANWSNAARAAYCARTTYWSNYTNAARYTNTTYWSNGTNCANGCNGCNGAYCANGCNGTNTAYTTYTGYGCNMGNCANTAYTAYGAYATHYTNCANGGNTAYCCNTTYTAYTTYGAYTAYTGGGGNCARGGNCANYTNGTNCANGTNWSNWSN

SEQ ID NO: 694 - protein, 375 aa, Homo Sapiens; identical to SEQ ID NO: 693

SEQ ID NO: 695 - protein, 360 aa, Homo Sapiens
CARGTNCARYTNCARCARTGGGGNGCNGGNYTNYTNAARCCNWSNGARCANYTNWSNYTNCANTGYGCNGTNTAYGGNGGNWSNTTYWSNGGNTAYTAYTGGWSNTGGATHMGNCARCCNCCNGGNAARGGNYTNGARTGGATHGGNGARATHAAYCAYWSNGGNWSNCANAAYTAYAAYCCNWSNYTNAARWSNMGNGTNCANATHWSNGTNGAYCANWSNAARAAYCARTTYWSNYTNAARYTNWSNWSNGTNCANGCNGCNGAYCANGCNGTNTAYTAYTGYGCNMGNGGNGGNTAYWSNWSNWSNTGGTAYTGGTTYGAYCCNTGGGGNCARGGNCANYTNGTNCANGTNWSNWSN

SEQ ID NO: 696 - protein, 360 aa, Homo Sapiens
CARGTNCARYTNCARCARTGGGGNGCNGGNYTNYTNAARCCNWSNGARCANYTNWSNYTNCANTGYGCNGTNTAYGGNGGNWSNTTYWSNGGNTAYTAYTGGWSNTGGATHMGNCARCCNCCNGGNAARGGNYTNGARTGGATHGGNGARATHAAYCAYWSNGGNWSNCANAAYTAYAAYCCNWSNYTNAARWSNMGNGTNCANATHWSNGTNGAYCANWSNAARAAYCARTTYWSNYTNAARYTNWSNWSNGTNCANGCNGCNGAYCANGCNGTNTAYTAYTGYGCNMGNGGNGGNTAYWSNWSNWSNTGGTTYTGGTTYGAYCCNTGGGGNCARGGNCANYTNGTNCANGTNWSNWSN

SEQ ID NO: 697 - protein, 369 aa, Homo Sapiens
CARGTNCARYTNCARGARWSNGGNCCNGGNYTNGTNAARCCNWSNGARCANYTNWSNYTNCANTGYCANGTNWSNGGNGGNWSNATHWSNWSNTAYTAYTGGWSNTGGATHMGNCARCCNGCNGGNAARGGNYTNGARTGGATHGGNMGNATHTAYCANWSNGGNCANCANAAYTAYAAYCCNWSNYTNAARWSNMGNGTNCANATGWSNGTNGAYCANWSNAARAAYCARTTYWSNYTNAARYTNWSNWSNGTNCANGCNGCNGAYCANGCNGTNTAYTAYTGYGCNMGNGAYGGNTAYWSNTAYGGNCAYTAYTAYTAYTAYGGNATGGAYGTNTGGGGNCARGGNCANCANGTNCANGTNWSNWSN

SEQ ID NO: 698 - protein, 378 aa, Homo Sapiens
CARGTNCARYTNCARGARWSNGGNCCNGGNYTNGTNAARCCNWSNGARCANYTNWSNYTNCANTGYCANGTNWSNGGNGGNWSNGTNWSNWSNGGNGGNWSNTAYTGGWSNTGGATHMGNCARCCNCCNGGNAARGGNYTNGARTGGATHGGNTAYATHTAYTAYWSNGGNWSNCANAAYTAYAAYCCNWSNYTNAARWSNMGNGTNCANATHWSNATHGTNCANWSNMGNAAYCARTTYWSNYTNAARYTNWSNWSNGTNCANGCNGCNGAYCANGCNGTNTAYTAYTGYGCNMGNWSNGCNYTNMGNTAYTTYGAYTGGYTNTTYWSNGAYGTNWSNGAYATHTGGGGNCARGGNCANATGGTNCANGTNWSNWSN

SEQ ID NO: 699 - protein, 360 aa, Homo Sapiens
GARGTNCARYTNGTNCARWSNGGNGCNGARYTNAARAARCCNGGNGARWSNYTNAARATHWSNTGYAARGGNWSNGGNTAYMGNTTYCANWSNTAYTGGATHGGNTGGGTNMGNCARATGCCNGGNAARGGNYTNGARTGGATGGGNATHATHTAYCCNGAYGAYWSNGAYCANMGNTAYWSNCCNWSNTTYCARGGNCARGTNCANATHWSNGCNGAYAARWSNATHWSNCANGCNTAYYTNCARTGGWSNWSNYTNAARGCNWSNGAYCANGCNATGTAYTAYTGYGCNMGNCARAARWSNTAYGGNTAYWSNTAYTTYGAYTAYTGGGGNCARGGNCANYTNGTNCANGTNWSNWSN

SEQ ID NO: 700 - protein, 363 aa, Homo Sapiens
GARGTNCARYTNGTNCARWSNGGNGCNGARGTNAARAARCCNGGNGARWSNYTNAARATHWSNTGYAARGGNWSNGGNTAYWSNTTYCANWSNTAYTGGATHGGNTGGGTNMGNCARATGCCNGGNAARGGNYTNGARTGGATGGGNATHATHTAYCCNGAYGAYWSNGAYGCNMGNTAYWSNCCNWSNTTYCARGGNCARGTNCANATHWSNGCNGAYAARWSNATHAAYCANGCNTAYYTNCARTGGWSNWSNYTNAARGCNWSNGAYCANGCNATGTAYTAYTGYGCNMGNCARGGNTAYGGNWSNGGNTGGGGNTAYTTYGAYTAYTGGGGNCARGGNCANYTNGTNCANGTNWSNWSN

SEQ ID NO: 701 - protein, 381 aa, Homo Sapiens
GARGTNCARYTNGTNCARWSNGGNGCNGARGTNAARAARCCNGGNGARWSNYTNAARATHWSNTGYAARGGNWSNGGNTAYWSNTTYCANWSNTAYTGGATHGGNTGGGTNMGNCARATGCCNGGNAARGGNYTNGARTGGATGGGNATHATHTAYCCNGGNGAYWSNGAYATHMGNTAYWSNCCNWSNTTYCARGGNCARGTNCANATHWSNGCNGAYAARWSNATHWSNCANGCNTAYYTNCARTGGWSNWSNYTNAARGCNWSNGAYCANGCNATGTAYTAYTGYGCNMGNCARGGNYTNGCNGTNGCNGGNCANWSNTAYTAYTAYTAYTAYGGNATGGAYGTNTGGGGNCARGGNCANCANGTNCANGTNWSNWSN

SEQ ID NO: 702 - protein, 375 aa, Homo Sapiens
CARGTNCARYTNCARCARWSNGGNCCNGGNYTNGTNAARCCNWSNCARCANYTNWSNYTNCANTGYGCNATHWSNGGNGAYWSNGTNWSNWSNTAYWSNGCNGCNTGGAAYTGGATHMGNCARWSNCCNWSNMGNGGNYTNGARTGGYTNGGNMGNCANTAYTGYMGNWSNAARTGGTAYAAYGAYTAYGCNGTNWSNGTNAARWSNMGNATHCANATHAAYCCNGAYCANWSNAARAAYCARTTYWSNYTNCARYTNAAYWSNGTNCANCCNGARGAYCANGCNGTNTAYTAYTGYGCNMGNGAYMGNGCNGTNGCNGGNTAYTAYTAYGGNATGGAYGTNTGGGGNCARGGNCANCANGTNCANGTNWSNWSN

SEQ ID NO: 703 - DNA, 324 bp, Homo Sapiens
cgaactgtggctgcaccatctgtcttcatcttcccgccatctgatgagcagttgaaatctggaactgctagcgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 704 - DNA, 981 bp, Homo Sapiens
gcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 705 - protein, 48 aa, Homo Sapiens
MGNWSNWSNCARWSNYTNGTNTAYWSNGAYGGNAAYCANTAYYTNAAY

SEQ ID NO: 706 - protein, 48 aa, Homo Sapiens
AARWSNWSNCARWSNYTNYTNCAYWSNGAYGGNAARCANTAYYTNTAY

SEQ ID NO: 707 - protein, 33 aa, Homo Sapiens
MGNGCNWSNCARGGNATHGCNAAYTAYYTNGCN

SEQ ID NO: 708 - protein, 33 aa, Homo Sapiens
MGNGCNWSNCARGGNATHWSNAAYGAYYTNGCN

SEQ ID NO: 709 - protein, 48 aa, Homo Sapiens
MGNWSNWSNCARWSNYTNGTNCAYWSNGAYGGNAAYCANTAYYTNWSN

SEQ ID NO: 710 - protein, 36 aa, Homo Sapiens
MGNGCNWSNCARCANGTNATHWSNWSNTAYYTNGCN

SEQ ID NO: 711 - protein, 30 aa, Homo Sapiens
MGNGCNWSNCARWSNGTNWSNMGNYTNGCN

SEQ ID NO: 712 - protein, 33 aa, Homo Sapiens
MGNGCNWSNCARGGNATHMGNAAYGAYYTNGGN

SEQ ID NO: 713 - protein, 51 aa, Homo Sapiens
AARWSNWSNCARWSNGTNYTNTAYWSNWSNAAYAAYAARAAYTAYYTNGTN

SEQ ID NO: 714 - protein, 51 aa, Homo Sapiens
AARWSNWSNCARWSNGTNYTNTAYWSNWSNAAYAAYAARAAYTAYYTNGCN

SEQ ID NO: 715 - protein, 51 aa, Homo Sapiens
AARWSNWSNCARAAYGTNYTNTAYWSNWSNAAYAAYAARAAYTAYYTNGCN

SEQ ID NO: 716 - protein, 51 aa, Homo Sapiens
AARWSNWSNCARWSNGTNYTNTAYAAYWSNAAYAAYAARAAYTAYYTNGCN

SEQ ID NO: 717 - protein, 51 aa, Homo Sapiens
AARWSNWSNCARWSNGTNYTNGAYWSNWSNAAYAAYAARAAYTAYYTNGCN

SEQ ID NO: 718 - protein, 51 aa, Homo Sapiens
AARWSNWSNCARWSNATHYTNTAYMGNWSNAAYAAYAARAAYTAYYTNGCN

SEQ ID NO: 719 - protein, 33 aa, Homo Sapiens
MGNGCNWSNCARGAYATHWSNCAYTAYYTNGCN

SEQ ID NO: 720 - protein, 33 aa, Homo Sapiens
MGNGCNWSNCARGAYATHWSNAAYTAYYTNGCN

SEQ ID NO: 721 - protein, 33 aa, Homo Sapiens
MGNGCNWSNCARWSNGTNWSNWSNAAYYTNGCN

SEQ ID NO: 722 - protein, 33 aa, Homo Sapiens
MGNGCNWSNCARGAYATHWSNMGNTGGYTNGCN

SEQ ID NO: 723 - protein, 33 aa, Homo Sapiens
MGNGCNWSNCARWSNATHWSNCANTAYYTNAAY

SEQ ID NO: 724 - protein, 33 aa, Homo Sapiens
MGNGCNWSNCARCANATHWSNATHTAYYTNAAY

SEQ ID NO: 725 - protein, 33 aa, Homo Sapiens
MGNGCNWSNCARWSNATHMGNWSNTAYYTNAAY

SEQ ID NO: 726 - protein, 33 aa, Homo Sapiens
MGNGCNWSNCARCANATHWSNMGNTAYYTNAAY

SEQ ID NO: 727 - protein, 33 aa, Homo Sapiens
MGNGCNWSNCARMGNATHWSNWSNTAYYTNAAY

SEQ ID NO: 728 - protein, 33 aa, Homo Sapiens
MGNGCNWSNCARWSNATHWSNMGNTAYYTNAAY

SEQ ID NO: 729 - protein, 33 aa, Homo Sapiens
MGNGCNWSNCARWSNATHWSNWSNTAYYTNAAY

SEQ ID NO: 730 - protein, 33 aa, Homo Sapiens
CARGCNWSNCARGAYATHWSNAAYTAYYTNAAY

SEQ ID NO: 731 - protein, 33 aa, Homo Sapiens
CARGCNWSNCARGAYATHWSNAAYWSNYTNAAY

SEQ ID NO: 732 - protein, 33 aa, Homo Sapiens
CARGCNWSNCARGAYATHWSNGAYTAYYTNAAY

SEQ ID NO: 733 - protein, 33 aa, Homo Sapiens
CARGCNWSNCARGAYATHCANAAYTAYYTNAAY

SEQ ID NO: 734 - protein, 21 aa, Homo Sapiens
AARGTNWSNAAYTGGGAYWSN

SEQ ID NO: 735 - protein, 21 aa, Homo Sapiens
GARGTNWSNAAYMGNTTYWSN

SEQ ID NO: 736 - protein, 21 aa, Homo Sapiens
GTNGCNWSNCANYTNCARWSN

SEQ ID NO: 737 - protein, 21 aa, Homo Sapiens
GCNGCNWSNCANYTNCARWSN

SEQ ID NO: 738 - protein, 21 aa, Homo Sapiens
AARATHWSNAAYMGNTTYWSN

SEQ ID NO: 739 - protein, 21 aa, Homo Sapiens
GGNGCNWSNWSNMGNGCNCAN

SEQ ID NO: 740 - protein, 21 aa, Homo Sapiens
GGNGCNWSNMGNMGNGCNCAN

SEQ ID NO: 741 - protein, 21 aa, Homo Sapiens
GCNGCNWSNWSNYTNCARWSN

SEQ ID NO: 742 - protein, 21 aa, Homo Sapiens
TGGGCNWSNCANMGNGARWSN

SEQ ID NO: 743 - protein, 21 aa, Homo Sapiens
TGGGCNWSNCANMGNAARWSN

SEQ ID NO: 744 - protein, 21 aa, Homo Sapiens
TGGGCNWSNGCNMGNGARWSN

SEQ ID NO: 745 - protein, 21 aa, Homo Sapiens
GCNGARWSNWSNYTNCARWSN

SEQ ID NO: 746 - protein, 21 aa, Homo Sapiens
CANGCNWSNWSNYTNCARWSN

SEQ ID NO: 747 - protein, 21 aa, Homo Sapiens
CANGTNWSNWSNYTNCARWSN

SEQ ID NO: 748 - protein, 21 aa, Homo Sapiens
GAYGCNWSNAAYYTNGARCAN

SEQ ID NO: 749 - protein, 21 aa, Homo Sapiens
GAYGCNWSNATHYTNGARCAN

SEQ ID NO: 750 - protein, 27 aa, Homo Sapiens
ATGCARWSNCANCAYTGGCCNATHCAN

SEQ ID NO: 751 - protein, 27 aa, Homo Sapiens
ATHCARGGNCANCAYTGGCCNCANCAN

SEQ ID NO: 752 - protein, 27 aa, Homo Sapiens
ATGCARGGNCANCAYTGGCCNATHCAN

SEQ ID NO: 753 - protein, 27 aa, Homo Sapiens
ATGCARGGNATHCARYTNCCNTGYWSN

SEQ ID NO: 754 - protein, 27 aa, Homo Sapiens
ATGCARWSNATHCARYTNCCNYTNCAN

SEQ ID NO: 755 - protein, 27 aa, Homo Sapiens
ATGCARWSNATHCARYTNCCNATHCAN

SEQ ID NO: 756 - protein, 27 aa, Homo Sapiens
CARAAYTAYAAYWSNGCNCCNTTYCAN

SEQ ID NO: 757 - protein, 27 aa, Homo Sapiens
CARAARTAYAAYWSNGTNCCNYTNCAN

SEQ ID NO: 758 - protein, 27 aa, Homo Sapiens
ATGCARGCNCANCARTTYCCNCAYCAN

SEQ ID NO: 759 - protein, 27 aa, Homo Sapiens
CARCARTAYGGNWSNWSNCCNMGNCAN

SEQ ID NO: 760 - protein, 27 aa, Homo Sapiens
CARCARTAYGGNWSNWSNCCNMGNWSN

SEQ ID NO: 761 - protein, 27 aa, Homo Sapiens
YTNCARCAYAAYWSNTAYCCNCCNCAN

SEQ ID NO: 762 - protein, 27 aa, Homo Sapiens
CARCARTAYTAYWSNTTYCCNTGGCAN

SEQ ID NO: 763 - protein, 27 aa, Homo Sapiens
CARCARTAYTAYWSNCANCANTGGCAN

SEQ ID NO: 764 - protein, 27 aa, Homo Sapiens
CARCARTAYTAYGGNCANCCNMGNCAN

SEQ ID NO: 765 - protein, 27 aa, Homo Sapiens
CARCARTAYTAYWSNATHWSNMGNCAN

SEQ ID NO: 766 - protein, 27 aa, Homo Sapiens
CARCARTAYTAYWSNCANATGTTYWSN

SEQ ID NO: 767 - protein, 27 aa, Homo Sapiens
CAYCARTAYTAYWSNCANCCNYTNCAN

SEQ ID NO: 768 - protein, 27 aa, Homo Sapiens
CARCARTAYTTYATHCANCCNYTNCAN

SEQ ID NO: 769 - protein, 27 aa, Homo Sapiens
CARCARTAYAAYAAYTAYCCNTTYCAN

SEQ ID NO: 770 - protein, 27 aa, Homo Sapiens
CARCARTAYAAYCANTAYCCNTTYCAN

SEQ ID NO: 771 - protein, 30 aa, Homo Sapiens
CARCARCAYAAYAAYTGGCCNCCNTGGCAN

SEQ ID NO: 772 - protein, 27 aa, Homo Sapiens
CARCARGCNAAYWSNTTYCCNCCNCAN

SEQ ID NO: 773 - protein, 27 aa, Homo Sapiens
CARCARWSNCAYWSNGCNCCNTTYCAN

SEQ ID NO: 774 - protein, 24 aa, Homo Sapiens
CARCARWSNTAYWSNCANYTNCAN

SEQ ID NO: 775 - protein, 27 aa, Homo Sapiens
CARCARWSNTAYWSNATHCCNYTNCAN

SEQ ID NO: 776 - protein, 27 aa, Homo Sapiens
CARCARATHTAYWSNCANWSNATHCAN

SEQ ID NO: 777 - protein, 27 aa, Homo Sapiens
CARCARWSNTAYATHCANCCNATHCAN

SEQ ID NO: 778 - protein, 27 aa, Homo Sapiens
CARCARWSNTAYTTYCANCCNATHCAN

SEQ ID NO: 779 - protein, 27 aa, Homo Sapiens
CARCARWSNTAYTTYWSNCCNATHCAN

SEQ ID NO: 780 - protein, 27 aa, Homo Sapiens
CARCARWSNTTYTAYCANCCNATHCAN

SEQ ID NO: 781 - protein, 27 aa, Homo Sapiens
CARCARWSNTTYTAYGCNCCNATHCAN

SEQ ID NO: 782 - protein, 27 aa, Homo Sapiens
CARCARTAYGAYTAYYTNCCNTTYCAN

SEQ ID NO: 783 - protein, 27 aa, Homo Sapiens
CARCARTGYGAYGAYYTNCCNYTNCAN

SEQ ID NO: 784 - protein, 27 aa, Homo Sapiens
CARCAYTAYGAYAAYYTNCCNYTNCAN

SEQ ID NO: 785 - protein, 27 aa, Homo Sapiens
CARCARTAYGAYAAYYTNCCNYTNCAN

SEQ ID NO: 786 - protein, 27 aa, Homo Sapiens
CARCARTGYGAYATHYTNCCNYTNWSN

SEQ ID NO: 787 - protein, 27 aa, Homo Sapiens
CARCARTAYGAYAAYYTNCCNYTNGCN

SEQ ID NO: 788 - protein, 27 aa, Homo Sapiens
CARCARTAYGAYWSNYTNCCNATHCAN

SEQ ID NO: 789 - protein, 27 aa, Homo Sapiens
CARCARTAYGAYAAYYTNCCNATHCAN

SEQ ID NO: 790 - protein, 27 aa, Homo Sapiens
CARCAYTAYGAYAAYYTNCCNATHCAN

SEQ ID NO: 791 - protein, 30 aa, Homo Sapiens
GGNTAYCANTTYCANWSNTAYGGNATHWSN

SEQ ID NO: 792 - protein, 30 aa, Homo Sapiens
GGNTAYCANTTYCANGGNCAYTAYATGCAY

SEQ ID NO: 793 - protein, 30 aa, Homo Sapiens
GGNTAYCANTTYCANGGNTAYTAYATGCAY

SEQ ID NO: 794 - protein, 30 aa, Homo Sapiens
GGNTAYCANYTNCANGARYTNWSNATGCAY

SEQ ID NO: 795 - protein, 36 aa, Homo Sapiens
GGNTTYWSNYTNWSNAAYGCNMGNATGGGNGTNWSN

SEQ ID NO: 796 - protein, 36 aa, Homo Sapiens
GGNTTYWSNYTNWSNCANGGNGGNGTNGGNGTNGGN

SEQ ID NO: 797 - protein, 36 aa, Homo Sapiens
GGNTTYWSNYTNAAYCANGGNGGNGTNGGNGTNGGN

SEQ ID NO: 798 - protein, 30 aa, Homo Sapiens
GGNTTYCCNTTYWSNMGNTAYWSNATGAAY

SEQ ID NO: 799 - protein, 30 aa, Homo Sapiens
GGNTTYCANTTYWSNWSNTAYGCNATGAAY

SEQ ID NO: 800 - protein, 30 aa, Homo Sapiens
GGNTTYCANTTYWSNWSNTAYGCNATGWSN

SEQ ID NO: 801 - protein, 30 aa, Homo Sapiens
GGNTTYCANTTYWSNWSNTAYGGNATGCAY

SEQ ID NO: 802 - protein, 30 aa, Homo Sapiens
GGNTTYCANTTYWSNWSNTAYGAYATGCAY

SEQ ID NO: 803 - protein, 30 aa, Homo Sapiens
GGNTTYCANTTYMGNWSNCAYGGNATGCAY

SEQ ID NO: 804 - protein, 30 aa, Homo Sapiens
GGNTTYCANTTYWSNGCNTAYWSNATGAAY

SEQ ID NO: 805 - protein, 30 aa, Homo Sapiens
GGNTTYCANTTYWSNWSNTAYWSNATGAAY

SEQ ID NO: 806 - protein, 36 aa, Homo Sapiens
GGNGGNWSNGTNWSNWSNGGNGGNTAYTAYTGGWSN

SEQ ID NO: 807 - protein, 36 aa, Homo Sapiens
GGNGGNWSNATHWSNMGNGGNGGNTAYTAYTGGWSN

SEQ ID NO: 808 - protein, 36 aa, Homo Sapiens
GGNGGNWSNATHWSNWSNGGNGGNTAYTAYTGGWSN

SEQ ID NO: 809 - protein, 36 aa, Homo Sapiens
GGNGGNWSNATHWSNWSNGGNGAYTAYTAYTGGAAY

SEQ ID NO: 810 - protein, 30 aa, Homo Sapiens
GGNGGNWSNTTYWSNGGNTAYTAYTGGWSN

SEQ ID NO: 811 - protein, 30 aa, Homo Sapiens
GGNGGNWSNATHWSNWSNTAYTAYTGGWSN

SEQ ID NO: 812 - protein, 36 aa, Homo Sapiens
GGNGGNWSNGTNWSNWSNGGNGGNWSNTAYTGGWSN

SEQ ID NO: 813 - protein, 30 aa, Homo Sapiens
GGNTAYMGNTTYCANWSNTAYTGGATHGGN

SEQ ID NO: 814 - protein, 30 aa, Homo Sapiens
GGNTAYWSNTTYCANWSNTAYTGGATHGGN

SEQ ID NO: 815 - protein, 36 aa, Homo Sapiens
GGNGAYWSNGTNWSNWSNTAYWSNGCNGCNTGGAAY

SEQ ID NO: 816 - protein, 51 aa, Homo Sapiens
TGGATHWSNGCNWSNAAYGGNAAYCANAAYTAYGCNCARAARYTNCARGAY

SEQ ID NO: 817 - protein, 51 aa, Homo Sapiens
TGGATHAAYCCNAAYWSNGGNGGNCANAAYTGYGCNCARAARTTYCARGGN

SEQ ID NO: 818 - protein, 51 aa, Homo Sapiens
TGGATHAAYCCNAAYWSNGGNGGNCANAAYCAYCANCARAARTTYCARGGN

SEQ ID NO: 819 - protein, 51 aa, Homo Sapiens
WSNTTYGAYCCNGARGAYGGNGARCANATHTAYGCNCARAARTTYCARGGN

SEQ ID NO: 820 - protein, 48 aa, Homo Sapiens
CAYATHTTYWSNAAYGAYGARAARWSNTAYWSNCANWSNYTNAARWSN

SEQ ID NO: 821 - protein, 48 aa, Homo Sapiens
YTNATHTTYWSNAAYGAYGARAARWSNTAYWSNCANWSNYTNAARWSN

SEQ ID NO: 822 - protein, 48 aa, Homo Sapiens
YTNATHTAYTGGAAYGAYGAYAARMGNTAYWSNCCNWSNYTNAARWSN

SEQ ID NO: 823 - protein, 48 aa, Homo Sapiens
YTNATHTAYTGGAAYGTNGARAARMGNTAYWSNCCNWSNYTNMGNWSN

SEQ ID NO: 824 - protein, 51 aa, Homo Sapiens
GCNATHWSNWSNWSNWSNWSNTAYATHTAYTAYGCNGAYWSNGTNAARGGN

SEQ ID NO: 825 - protein, 51 aa, Homo Sapiens
GCNATHWSNGGNWSNGGNGGNWSNCANTAYTAYGCNGAYWSNGTNAARGGN

SEQ ID NO: 826 - protein, 51 aa, Homo Sapiens
TTYATHWSNGAYGAYGGNWSNCANAARTAYTAYGCNGAYWSNGTNAARGGN

SEQ ID NO: 827 - protein, 51 aa, Homo Sapiens
GTNATHTGGTAYGAYGGNWSNAAYAARTAYTAYGCNGAYWSNGTNAARGGN

SEQ ID NO: 828 - protein, 51 aa, Homo Sapiens
GTNATHTGGTAYGAYGGNWSNATHAARTAYTAYGCNGAYWSNGTNAARGGN

SEQ ID NO: 829 - protein, 51 aa, Homo Sapiens
GTNATHTGGWSNGAYGGNWSNAAYAARTAYTAYGCNGAYWSNGTNAARGGN

SEQ ID NO: 830 - protein, 51 aa, Homo Sapiens
GTNATHTGGGAYGAYGGNWSNAAYCARTAYTAYCANGAYWSNGTNAARGGN

SEQ ID NO: 831 - protein, 51 aa, Homo Sapiens
GTNATHTGGTAYGAYGGNWSNAAYAARMGNTAYGTNGAYWSNGTNAARGGN

SEQ ID NO: 832 - protein, 51 aa, Homo Sapiens
GTNATHTGGTAYGAYGGNWSNAAYAARAAYTAYGCNGAYWSNGTNMGNGGN

SEQ ID NO: 833 - protein, 51 aa, Homo Sapiens
TAYATHWSNWSNWSNGGNMGNCANATHTAYTAYGCNGAYWSNGTNAARGGN

SEQ ID NO: 834 - protein, 51 aa, Homo Sapiens
CAYATHWSNWSNWSNWSNMGNCANATHTAYTAYGCNGAYWSNGTNAARGGN

SEQ ID NO: 835 - protein, 51 aa, Homo Sapiens
CAYATHWSNMGNWSNWSNMGNCANATHTAYTAYGCNGAYWSNGTNAARGGN

SEQ ID NO: 836 - protein, 48 aa, Homo Sapiens
TAYATHCAYWSNWSNGGNWSNCANTAYTAYAAYCCNWSNYTNAARWSN

SEQ ID NO: 837 - protein, 48 aa, Homo Sapiens
TAYATHTAYCAYWSNGGNWSNCANTAYTAYAAYCCNWSNYTNAARWSN

SEQ ID NO: 838 - protein, 48 aa, Homo Sapiens
TAYATHTAYTAYWSNGGNWSNCANTAYTAYAAYCCNWSNYTNAARWSN

SEQ ID NO: 839 - protein, 48 aa, Homo Sapiens
TAYATHCAYTAYWSNGGNWSNCANTAYTAYAAYCCNWSNYTNAARWSN

SEQ ID NO: 840 - protein, 48 aa, Homo Sapiens
TAYATHTAYTAYWSNGGNGGNCANTAYTAYAAYCCNWSNYTNAARWSN

SEQ ID NO: 841 - protein, 48 aa, Homo Sapiens
GARATHAAYCAYWSNGGNWSNCANAAYTAYAAYCCNWSNYTNAARWSN

SEQ ID NO: 842 - protein, 48 aa, Homo Sapiens
MGNATHTAYCANWSNGGNCANCANAAYTAYAAYCCNWSNYTNAARWSN

SEQ ID NO: 843 - protein, 48 aa, Homo Sapiens
TAYATHTAYTAYWSNGGNWSNCANAAYTAYAAYCCNWSNYTNAARWSN

SEQ ID NO: 844 - protein, 51 aa, Homo Sapiens
ATHATHTAYCCNGAYGAYWSNGAYCANMGNTAYWSNCCNWSNTTYCARGGN

SEQ ID NO: 845 - protein, 51 aa, Homo Sapiens
ATHATHTAYCCNGAYGAYWSNGAYGCNMGNTAYWSNCCNWSNTTYCARGGN

SEQ ID NO: 846 - protein, 51 aa, Homo Sapiens
ATHATHTAYCCNGGNGAYWSNGAYATHMGNTAYWSNCCNWSNTTYCARGGN

SEQ ID NO: 847 - protein, 54 aa, Homo Sapiens
MGNCANTAYTGYMGNWSNAARTGGTAYAAYGAYTAYGCNGTNWSNGTNAARWSN

SEQ ID NO: 848 - protein, 33 aa, Homo Sapiens
GARGAYAAYTGGAAYTAYGGNTTYTTYGAYTAY

SEQ ID NO: 849 - protein, 24 aa, Homo Sapiens
WSNATHGCNGTNGCNYTNGAYTAY

SEQ ID NO: 850 - protein, 39 aa, Homo Sapiens
GARGGNGAYGGNGGNTAYTAYTAYTAYGGNATGGAYGTN

SEQ ID NO: 851 - protein, 36 aa, Homo Sapiens
ATGTAYWSNWSNGGNTGGTAYGGNGTNTTYGAYTAY

SEQ ID NO: 852 - protein, 39 aa, Homo Sapiens
GTNTAYWSNWSNGGNTGGWSNTTYTAYGGNATGGAYGTN

SEQ ID NO: 853 - protein, 24 aa, Homo Sapiens
MGNMGNGARYTNCCNTTYGAYTAY

SEQ ID NO: 854 - protein, 24 aa, Homo Sapiens
MGNAAYTGGCANCCNTTYGAYTAY

SEQ ID NO: 855 - protein, 24 aa, Homo Sapiens
MGNYTNGARYTNCCNTTYGAYTAY

SEQ ID NO: 856 - protein, 24 aa, Homo Sapiens
MGNMGNGARGTNCCNTTYGAYTAY

SEQ ID NO: 857 - protein, 24 aa, Homo Sapiens
MGNCAYCANAAYCCNTTYGARTAY

SEQ ID NO: 858 - protein, 24 aa, Homo Sapiens
MGNGGNGARYTNCCNTTYGAYTAY

SEQ ID NO: 859 - protein, 36 aa, Homo Sapiens
GAYMGNGTNGGNGCNCANCCNGAYGCNTTYGAYATH

SEQ ID NO: 860 - protein, 57 aa, Homo Sapiens
GARGGNATHGCNGTNGCNGGNCANGCNGARTAYTAYTAYTAYTAYGCNATGGAYGTN

SEQ ID NO: 861 - protein, 48 aa, Homo Sapiens
GARGGNATHGCNGCNMGNGAYWSNTAYTAYTAYTAYGCNATGGAYGTN

SEQ ID NO: 862 - protein, 48 aa, Homo Sapiens
GARGGNATHGCNGGNMGNGAYWSNTAYTAYTAYTAYGGNATGGAYGTN

SEQ ID NO: 863 - protein, 42 aa, Homo Sapiens
WSNTAYTAYGAYWSNWSNGGNTAYTAYTAYGGNTTYGAYTAY

SEQ ID NO: 864 - protein, 15 aa, Homo Sapiens
AAYGTNATHGAYTAY

SEQ ID NO: 865 - protein, 33 aa, Homo Sapiens
GGNGGNGCNCANGGNGCNGARTAYTTYCARCAY

SEQ ID NO: 866 - protein, 27 aa, Homo Sapiens
YTNTGGTTYGGNGARCANTTYGAYTAY

SEQ ID NO: 867 - protein, 18 aa, Homo Sapiens
AAYYTNCCNTTYGAYTAY

SEQ ID NO: 868 - protein, 42 aa, Homo Sapiens
WSNCAYTAYGGNGGNGAYTAYGAYTAYTAYGGNATGGAYGTN

SEQ ID NO: 869 - protein, 33 aa, Homo Sapiens
GAYGGNTGGCARCARCARGCNCCNTTYGAYTAY

SEQ ID NO: 870 - protein, 27 aa, Homo Sapiens
TGGGGNATHWSNGCNCCNTTYGAYTGY

SEQ ID NO: 871 - protein, 18 aa, Homo Sapiens
TGGGCNCCNTTYGAYTAY

SEQ ID NO: 872 - protein, 48 aa, Homo Sapiens
GAYGGNTAYAAYTGGAAYGGNGGNGGNAAYTAYTAYGGNATGGAYGTN

SEQ ID NO: 873 - protein, 48 aa, Homo Sapiens
GAYGGNTAYAAYTGGAAYAAYGGNGGNTAYTAYTAYGGNATGGAYGTN

SEQ ID NO: 874 - protein, 24 aa, Homo Sapiens
GGNCCNTAYTAYGGNATGGAYGTN

SEQ ID NO: 875 - protein, 51 aa, Homo Sapiens
GCNYTNMGNGGNATHGTNYTNATGGTNTAYGTNYTNGGNGCNYTNGAYATH

SEQ ID NO: 876 - protein, 51 aa, Homo Sapiens
GAYGARCANGTNGTNMGNGGNYTNATHMGNTAYTGYTAYGGNATGGAYGTN

SEQ ID NO: 877 - protein, 36 aa, Homo Sapiens
GAYMGNGGNGGNGGNGAYTAYGGNMGNATGGAYGTN

SEQ ID NO: 878 - protein, 27 aa, Homo Sapiens
WSNAAYAAYTAYGGNTGYTTYGCNYTN

SEQ ID NO: 879 - protein, 69 aa, Homo Sapiens
GGNTAYAAYTAYGGNYTNTAYTAYTAYGAYWSNWSNGGNTAYCCNWSNTAYTAYTAYGGNATGGAYGTN

SEQ ID NO: 880 - protein, 45 aa, Homo Sapiens
CANTAYTAYGAYATHYTNCANGGNTAYCCNTTYTAYTTYGAYTAY

SEQ ID NO: 881 - protein, 36 aa, Homo Sapiens
GGNGGNTAYWSNWSNWSNTGGTAYTGGTTYGAYCCN

SEQ ID NO: 882 - protein, 36 aa, Homo Sapiens
GGNGGNTAYWSNWSNWSNTGGTTYTGGTTYGAYCCN

SEQ ID NO: 883 - protein, 45 aa, Homo Sapiens
GAYGGNTAYWSNTAYGGNCAYTAYTAYTAYTAYGGNATGGAYGTN

SEQ ID NO: 884 - protein, 48 aa, Homo Sapiens
WSNGCNYTNMGNTAYTTYGAYTGGYTNTTYWSNGAYGTNWSNGAYATH

SEQ ID NO: 885 - protein, 33 aa, Homo Sapiens
CARAARWSNTAYGGNTAYWSNTAYTTYGAYTAY

SEQ ID NO: 886 - protein, 36 aa, Homo Sapiens
CARGGNTAYGGNWSNGGNTGGGGNTAYTTYGAYTAY

SEQ ID NO: 887 - protein, 54 aa, Homo Sapiens
CARGGNYTNGCNGTNGCNGGNCANWSNTAYTAYTAYTAYTAYGGNATGGAYGTN

SEQ ID NO: 888 - protein, 39 aa, Homo Sapiens
GAYMGNGCNGTNGCNGGNTAYTAYTAYGGNATGGAYGTN

SEQ ID NO: 889 - protein, 69 aa, Homo Sapiens
GAYGTNGTNATGCANCARWSNCCNYTNWSNYTNCCNGTNCANYTNGGNCARCCNGCNWSNATHWSNTGY

SEQ ID NO: 890 - protein, 69 aa, Homo Sapiens; identical to SEQ ID NO: 889

SEQ ID NO: 891 - protein, 69 aa, Homo Sapiens
GAYATHGTNATGCANCARCANCCNYTNWSNYTNWSNGTNCANCCNGGNCARCCNGCNWSNATHWSNTGY

SEQ ID NO: 892 - protein, 69 aa, Homo Sapiens; identical to SEQ ID NO: 891

SEQ ID NO: 893 - protein, 69 aa, Homo Sapiens
GAYATHCARATGCANCARWSNCCNWSNWSNYTNWSNGCNWSNGTNGGNGAYMGNGTNCANATHATHTGY

SEQ ID NO: 894 - protein, 69 aa, Homo Sapiens
AAYATHGTNATGCANCARCANCCNYTNWSNWSNCCNGTNCANYTNGGNCARCCNGCNWSNATHWSNTGY

SEQ ID NO: 895 - protein, 69 aa, Homo Sapiens
GARATHGTNYTNCANCARWSNCCNGGNCANYTNWSNYTNWSNCCNGGNGARMGNGCNCANYTNWSNTGY

SEQ ID NO: 896 - protein, 69 aa, Homo Sapiens; identical to SEQ ID NO: 895

SEQ ID NO: 897 - protein, 69 aa, Homo Sapiens
GAYATHCARATGCANCARWSNCCNWSNWSNYTNWSNGCNWSNGTNGGNGAYMGNGTNCANATHCANTGY

SEQ ID NO: 898 - protein, 69 aa, Homo Sapiens
GAYATHGTNATGCANCARWSNCCNGAYWSNYTNGCNGTNWSNYTNGGNGARMGNGCNCANATHAAYTGY

SEQ ID NO: 899 - protein, 69 aa, Homo Sapiens
GAYATHGTNATGCANCARWSNCCNGAYWSNYTNCANGTNWSNYTNGGNGARMGNGCNCANATHAAYTGY

SEQ ID NO: 900 - protein, 69 aa, Homo Sapiens; identical to SEQ ID NO: 898

SEQ ID NO: 901 - protein, 69 aa, Homo Sapiens; identical to SEQ ID NO: 897

SEQ ID NO: 902 - protein, 69 aa, Homo Sapiens
GAYATHCARATGCANCARWSNCCNWSNWSNYTNWSNGCNWSNGTNGGNGAYMGNGTNGCNATHCANTGY

SEQ ID NO: 903 - protein, 69 aa, Homo Sapiens
GARATHGTNATGCANCARWSNCCNGCNCANYTNWSNGTNWSNCCNGGNGARMGNGCNCANYTNWSNTGY

SEQ ID NO: 904 - protein, 69 aa, Homo Sapiens
GAYATHCARATGCANCARWSNCCNWSNWSNGTNWSNGCNWSNGTNGGNGAYMGNGTNCANATHCANTGY

SEQ ID NO: 905 - protein, 69 aa, Homo Sapiens; identical to SEQ ID NO: 897

SEQ ID NO: 906 - protein, 69 aa, Homo Sapiens; identical to SEQ ID NO: 897

SEQ ID NO: 907 - protein, 69 aa, Homo Sapiens; identical to SEQ ID NO: 897

SEQ ID NO: 908 - protein, 69 aa, Homo Sapiens; identical to SEQ ID NO: 897

SEQ ID NO: 909 - protein, 69 aa, Homo Sapiens; identical to SEQ ID NO: 897

SEQ ID NO: 910 - protein, 45 aa, Homo Sapiens
TGGYTNCARCARMGNCCNGGNCARWSNCCNMGNMGNYTNATHTAY

SEQ ID NO: 911 - protein, 45 aa, Homo Sapiens
TGGTAYYTNCARAARCCNGGNCARCCNCCNCARYTNYTNATHTAY

SEQ ID NO: 912 - protein, 45 aa, Homo Sapiens
TGGTTYYTNCARAARCCNGGNCARCCNCCNCARCCNYTNATHTAY

SEQ ID NO: 913 - protein, 45 aa, Homo Sapiens
TGGTAYCARCARAARCCNGGNAARGTNCCNAARYTNYTNATHTAY

SEQ ID NO: 914 - protein, 45 aa, Homo Sapiens
TGGYTNCARCARMGNCCNGGNCARCCNCCNMGNYTNYTNATHTAY

SEQ ID NO: 915 - protein, 45 aa, Homo Sapiens
TGGTAYCARCARAARCCNGGNCARGCNCCNMGNYTNYTNATHWSN

SEQ ID NO: 916 - protein, 45 aa, Homo Sapiens
TGGTAYCARCARAARCCNGGNCARGCNCCNMGNYTNYTNATHTAY

SEQ ID NO: 917 - protein, 45 aa, Homo Sapiens
TGGTAYCARCARAARCCNGGNAARGCNCCNAARMGNYTNATHTAY

SEQ ID NO: 918 - protein, 45 aa, Homo Sapiens
TGGTAYCARCARAARCCNGGNCARCCNCCNAARYTNTTYATHTAY

SEQ ID NO: 919 - protein, 45 aa, Homo Sapiens
TGGTAYCARCARAARCCNGGNCARCCNCCNAARYTNYTNATHTAY

SEQ ID NO: 920 - protein, 45 aa, Homo Sapiens
TGGTAYCARCARAARCCNGGNCARCCNCCNAARGTNYTNATHTAY

SEQ ID NO: 921 - protein, 45 aa, Homo Sapiens
TGGTTYCARCARAARCCNGGNAARGCNCCNAARWSNYTNATHTAY

SEQ ID NO: 922 - protein, 45 aa, Homo Sapiens
TGGYTNCARCARAARCCNGGNAARGCNCCNAARWSNYTNATHTAY

SEQ ID NO: 923 - protein, 45 aa, Homo Sapiens
TGGTAYCARCARGAYCCNGGNCARGCNCCNMGNYTNYTNATHTAY

SEQ ID NO: 924 - protein, 45 aa, Homo Sapiens
TGGTAYCARCARAARCCNGGNAARGCNCCNAARYTNYTNATHTAY

SEQ ID NO: 925 - protein, 45 aa, Homo Sapiens
TGGTAYCARCARAARCCNGGNAARGCNCCNAARTTYYTNATHTAY

SEQ ID NO: 926 - protein, 45 aa, Homo Sapiens
TGGTAYCARCARMGNCCNGGNAAYGCNCCNAARYTNYTNATHTAY

SEQ ID NO: 927 - protein, 45 aa, Homo Sapiens
TGGTAYCARCARAARCCNGGNAARGCNCCNAARGTNYTNATHTAY

SEQ ID NO: 928 - protein, 45 aa, Homo Sapiens
TGGTAYCARCARAARCCNGGNAARGCNCCNGARYTNYTNATHTAY

SEQ ID NO: 929 - protein, 45 aa, Homo Sapiens
TGGTAYCARCARAARYTNGGNAARGCNCCNAARYTNYTNATHCAY

SEQ ID NO: 930 - protein, 96 aa, Homo Sapiens
GGNGTNCCNGAYMGNTTYAAYGGNWSNGGNWSNGGNCANGAYTTYCANYTNAARATHWSNMGNGTNGARGCNGARGAYGTNGGNGTNTAYTAYTGY

SEQ ID NO: 931 - protein, 96 aa, Homo Sapiens
GGNGTNCCNGAYMGNTTYWSNGGNWSNGGNWSNGGNCANGAYTTYCANYTNAARATHWSNMGNGTNGARGCNGARGAYGTNGGNGTNTAYTAYTGY

SEQ ID NO: 932 - protein, 96 aa, Homo Sapiens
GGNGTNCCNWSNMGNTTYWSNGGNWSNGGNWSNGGNCANGAYTTYCANYTNCANATHWSNWSNYTNCARCCNGARGAYGTNGCNCANTAYTAYTGY

SEQ ID NO: 933 - protein, 96 aa, Homo Sapiens
GGNGTNCCNGAYMGNTTYWSNGGNWSNGGNGCNGGNCANGAYTTYCANYTNAARATHWSNMGNGTNGARGCNGARGAYGTNGGNGTNTAYTAYTGY

SEQ ID NO: 934 - protein, 96 aa, Homo Sapiens
GGNGTNCCNGAYMGNTTYWSNGGNCANGGNGCNGGNCANGAYTTYCANYTNAARATHWSNMGNGTNGARGCNGARGAYGTNGGNGTNTAYTAYTGY

SEQ ID NO: 935 - protein, 96 aa, Homo Sapiens
GGNATHCCNGAYMGNTTYWSNGGNWSNGGNWSNGGNCANGAYTTYCANYTNCANATHWSNMGNYTNGARCCNGARGAYTTYGCNGTNTAYTAYTGY

SEQ ID NO: 936 - protein, 96 aa, Homo Sapiens
GGNGTNCCNWSNMGNTTYWSNGGNWSNGGNWSNGGNCANGARTTYCANYTNCANATHWSNWSNYTNCARCCNGARGAYTTYGCNCANTAYTAYTGY

SEQ ID NO: 937 - protein, 96 aa, Homo Sapiens
GGNGTNCCNGAYMGNTTYCANGGNWSNGGNWSNGGNCANGAYTTYCANYTNCANATHWSNWSNYTNCARGCNGARGAYGTNGCNGTNTAYTAYTGY

SEQ ID NO: 938 - protein, 96 aa, Homo Sapiens
GGNGTNCCNGAYMGNTTYWSNGGNWSNGGNWSNGGNCANGAYTTYCANYTNCANATHWSNWSNYTNCARGCNGARGAYGTNGCNGTNTAYTAYTGY

SEQ ID NO: 939 - protein, 96 aa, Homo Sapiens
GGNGTNCCNGAYMGNTTYWSNGGNWSNGGNWSNGGNCANGAYTTYCANYTNCANATHWSNWSNYTNCARGCNGARGAYGTNGCNGTNTAYTTYTGY

SEQ ID NO: 940 - protein, 96 aa, Homo Sapiens
GGNGTNCCNGAYMGNTTYGGNGGNWSNGGNWSNGGNCANGAYTTYCANYTNCANATHWSNWSNYTNCARGCNGARGAYGTNGCNGTNTAYTAYTGY

SEQ ID NO: 941 - protein, 96 aa, Homo Sapiens
GGNGTNCCNGAYMGNTTYWSNGGNWSNGGNWSNGGNCANGAYTTYCANYTNCANATHWSNWSNYTNCARGCNGAYGAYGTNGCNGTNTAYTAYTGY

SEQ ID NO: 942 - protein, 96 aa, Homo Sapiens
GGNGTNCCNGAYMGNTTYWSNGGNWSNGGNWSNGGNCANGAYTTYCANYTNCANATHWSNGGNYTNCARGCNGARGAYGTNGCNYTNTAYTAYTGY

SEQ ID NO: 943 - protein, 96 aa, Homo Sapiens
GGNGTNCCNGAYMGNTTYWSNGGNWSNGGNWSNGGNCANGAYTTYCANYTNCANATHWSNWSNYTNCARGCNGARGAYGTNGCNGTNTTYTAYTGY

SEQ ID NO: 944 - protein, 96 aa, Homo Sapiens
GGNGTNCCNWSNAARTTYWSNGGNWSNGGNWSNGGNCANGAYTTYCANYTNCANATHWSNWSNYTNCARCCNGARGAYTTYGCNCANTAYTAYTGY

SEQ ID NO: 945 - protein, 96 aa, Homo Sapiens
GGNGTNCCNWSNMGNTTYWSNGGNWSNGGNWSNGGNCANGAYTTYCANYTNCANATHWSNWSNYTNCARCCNGARGAYTTYGCNCANTAYTAYTGY

SEQ ID NO: 946 - protein, 96 aa, Homo Sapiens
GGNATHCCNGCNMGNTTYWSNGGNWSNGGNWSNGGNCANGARTTYCANYTNCANATHWSNWSNYTNCARWSNGARGAYTTYGCNGTNTAYTAYTGY

SEQ ID NO: 947 - protein, 96 aa, Homo Sapiens
GGNGTNCCNWSNMGNTTYWSNGGNWSNGGNWSNGGNCANGAYTTYCANYTNCANATHWSNWSNYTNCARCCNGARGAYTTYGCNGCNTAYTAYTGY

SEQ ID NO: 948 - protein, 96 aa, Homo Sapiens
GGNGTNCCNWSNMGNGTNWSNGGNWSNGGNWSNGGNCANGAYTTYCANYTNCANATHMGNWSNYTNCARCCNGARGAYTTYGCNCANTAYTAYTGY

SEQ ID NO: 949 - protein, 96 aa, Homo Sapiens
GGNGTNCCNWSNMGNTTYWSNGGNWSNGGNWSNGGNCANGAYTTYCANYTNCANYTNWSNWSNYTNCARCCNGARGAYTTYGCNCANTAYTAYTGY

SEQ ID NO: 950 - protein, 96 aa, Homo Sapiens
GGNGTNCCNWSNMGNTTYWSNGGNWSNGGNWSNGGNCANGAYTTYCANYTNCANATHWSNWSNYTNCARCCNGARAAYTTYGCNCANTAYTAYTGY

SEQ ID NO: 951 - protein, 96 aa, Homo Sapiens
GGNGTNCCNWSNMGNTTYWSNGGNWSNGGNWSNGGNCANGAYTTYCANYTNCANTTYWSNWSNYTNCARCCNGARGAYTTYGCNCANTAYTAYTGY

SEQ ID NO: 952 - protein, 96 aa, Homo Sapiens
GGNGTNCCNWSNMGNTTYWSNGGNWSNGGNWSNGGNCANGAYTTYCANYTNCANYTNWSNWSNYTNCARCCNGARGAYTTYGCNWSNTAYTAYTGY

SEQ ID NO: 953 - protein, 96 aa, Homo Sapiens
GGNGTNCCNWSNMGNTTYWSNGGNWSNGGNWSNGGNCANGAYTTYCANYTNCANATHWSNWSNYTNCARCCNGARGAYTTYGCNWSNTAYTAYTGY

SEQ ID NO: 954 - protein, 96 aa, Homo Sapiens
GGNGTNCCNWSNMGNTTYWSNGGNWSNGGNWSNGGNCANGAYTTYCANTTYCANATHWSNWSNYTNCARCCNGARGAYATHGCNCANTAYTAYTGY

SEQ ID NO: 955 - protein, 96 aa, Homo Sapiens
GGNGTNCCNWSNMGNTTYWSNGGNWSNGGNWSNGARCANGAYTTYCANTTYCANATHWSNWSNYTNCARCCNGARGAYATHGCNCANTAYTAYTGY

SEQ ID NO: 956 - protein, 30 aa, Homo Sapiens
TTYGGNCARGGNCANMGNYTNGARATHAAR

SEQ ID NO: 957 - protein, 30 aa, Homo Sapiens
TTYGGNCARGGNCANMGNYTNGARATHATH

SEQ ID NO: 958 - protein, 30 aa, Homo Sapiens
TTYGGNCARGGNCANAARYTNGARATHAAR

SEQ ID NO: 959 - protein, 30 aa, Homo Sapiens
TTYGGNGGNGGNCANAARGTNGARATHAAR

SEQ ID NO: 960 - protein, 30 aa, Homo Sapiens
TTYGGNCAYGGNCANMGNYTNGARATHAAR

SEQ ID NO: 961 - protein, 30 aa, Homo Sapiens
TTYGGNCCNGGNCANAARGTNGAYATHAAR

SEQ ID NO: 962 - protein, 30 aa, Homo Sapiens
TTYGGNCARGGNCANAARGTNGARATHAAR

SEQ ID NO: 963 - protein, 30 aa, Homo Sapiens
TTYGGNCCNGGNCANAARGTNGARATHAAR

SEQ ID NO: 964 - protein, 30 aa, Homo Sapiens
TTYGGNGGNGGNCANAARGTNGCNATHAAR

SEQ ID NO: 965 - protein, 30 aa, Homo Sapiens
TTYGGNCCNGGNCANAARATGGAYATHAAR

SEQ ID NO: 966 - protein, 30 aa, Homo Sapiens
TTYGGNCARGGNCANAARGTNGARTTYAAR

SEQ ID NO: 967 - protein, 30 aa, Homo Sapiens
TTYGGNGGNGGNCANAARGTNGARATHMGN

SEQ ID NO: 968 - protein, 75 aa, Homo Sapiens
CARGTNCARYTNGTNCARWSNGGNGCNGARGTNAARAARCCNGGNGCNWSNGTNAARGTNWSNTGYAARGCNWSN

SEQ ID NO: 969 - protein, 75 aa, Homo Sapiens
CARGTNCAYYTNGTNCARWSNGGNGCNGARGTNAARAARCCNGGNGCNWSNGTNAARGTNWSNTGYAARGTNWSN

SEQ ID NO: 970 - protein, 75 aa, Homo Sapiens
CARGTNCARYTNGTNCARWSNGGNGCNGARGTNMGNAARCCNGGNGCNWSNGTNAARGTNWSNTGYAARGTNWSN

SEQ ID NO: 971 - protein, 75 aa, Homo Sapiens
CARGTNCANYTNAARGARWSNGGNCCNGTNYTNGTNAARCCNCANGARCANYTNCANYTNCANTGYCANGTNWSN

SEQ ID NO: 972 - protein, 75 aa, Homo Sapiens
CARATHCANYTNAARGARWSNGGNCCNCANYTNGTNAARCCNCANCARCANYTNCANYTNCANTGYCANTTYWSN

SEQ ID NO: 973 - protein, 75 aa, Homo Sapiens
GARGTNCARYTNGTNGARWSNGGNGGNGGNYTNGTNAARCCNGGNGGNWSNYTNMGNYTNWSNTGYGCNGCNWSN

SEQ ID NO: 974 - protein, 75 aa, Homo Sapiens
GARGTNCARYTNYTNGARWSNGGNGGNGGNYTNGTNCARCCNGGNGGNWSNYTNMGNYTNWSNTGYGCNGCNWSN

SEQ ID NO: 975 - protein, 75 aa, Homo Sapiens
GARGTNCARYTNYTNGARWSNGGNGGNGGNYTNGTNCARCCNGGNGGNWSNYTNMGNYTNWSNTGYCANGCNWSN

SEQ ID NO: 976 - protein, 75 aa, Homo Sapiens
CARGTNCARYTNGTNGARWSNGGNGGNGGNGTNGTNCARCCNGGNMGNWSNYTNMGNYTNWSNTGYGCNGCNWSN

SEQ ID NO: 977 - protein, 75 aa, Homo Sapiens
GARGTNCARYTNGTNGARWSNGGNGGNGGNYTNGTNCARCCNGGNGGNWSNYTNMGNYTNWSNTGYGCNGCNWSN

SEQ ID NO: 978 - protein, 75 aa, Homo Sapiens
CARGTNCARYTNCARGARWSNGGNCCNGGNYTNGTNAARCCNWSNCARCANYTNWSNYTNCANTGYCANGTNWSN

SEQ ID NO: 979 - protein, 75 aa, Homo Sapiens
CARGTNCARYTNCARGARWSNGGNCCNGGNYTNGTNAARCCNWSNCARCANYTNWSNYTNAAYTGYCANGTNWSN

SEQ ID NO: 980 - protein, 75 aa, Homo Sapiens
CARGTNCARYTNCARCARTGGGGNGCNGGNYTNYTNAARCCNWSNGARCANYTNWSNYTNCANTGYGCNGTNTAY

SEQ ID NO: 981 - protein, 75 aa, Homo Sapiens
CARGTNCARYTNCARGARWSNGGNCCNGGNYTNGTNAARCCNWSNGARCANYTNWSNYTNCANTGYCANGTNWSN

SEQ ID NO: 982 - protein, 75 aa, Homo Sapiens
GARGTNCARYTNGTNCARWSNGGNGCNGARYTNAARAARCCNGGNGARWSNYTNAARATHWSNTGYAARGGNWSN

SEQ ID NO: 983 - protein, 75 aa, Homo Sapiens
GARGTNCARYTNGTNCARWSNGGNGCNGARGTNAARAARCCNGGNGARWSNYTNAARATHWSNTGYAARGGNWSN

SEQ ID NO: 984 - protein, 75 aa, Homo Sapiens
CARGTNCARYTNCARCARWSNGGNCCNGGNYTNGTNAARCCNWSNCARCANYTNWSNYTNCANTGYGCNATHWSN

SEQ ID NO: 985 - protein, 42 aa, Homo Sapiens
TGGGTNMGNCARGCNCCNGGNCARGGNYTNGARTGGATGGGN

SEQ ID NO: 986 - protein, 42 aa, Homo Sapiens
TGGGTNMGNCARGCNCCNGGNAARGGNYTNGARTGGATGGGN

SEQ ID NO: 987 - protein, 42 aa, Homo Sapiens
TGGATHMGNCARCCNCCNGGNAARGCNYTNGARTGGYTNGCN

SEQ ID NO: 988 - protein, 42 aa, Homo Sapiens
TGGATHMGNCARCCNCCNGGNAARGCNYTNGARTGGYTNGTN

SEQ ID NO: 989 - protein, 42 aa, Homo Sapiens
TGGGTNMGNCARGCNCCNGGNAARGGNYTNGARTGGGTNWSN

SEQ ID NO: 990 - protein, 42 aa, Homo Sapiens
TGGGTNMGNCARGCNCCNGGNAARGGNYTNGARTGGGTNGCN

SEQ ID NO: 991 - protein, 42 aa, Homo Sapiens
TGGATHMGNCARCAYCCNGGNAARGGNYTNGARTGGATHGGN

SEQ ID NO: 992 - protein, 42 aa, Homo Sapiens
TGGGTNMGNCARCAYCCNGGNAARGGNYTNGARTGGATHGGN

SEQ ID NO: 993 - protein, 42 aa, Homo Sapiens
TGGATHMGNCARCCNCCNGGNAARGGNYTNGARTGGATHGGN

SEQ ID NO: 994 - protein, 42 aa, Homo Sapiens
TGGATHMGNCARCCNGCNGGNAARGGNYTNGARTGGATHGGN

SEQ ID NO: 995 - protein, 42 aa, Homo Sapiens
TGGGTNMGNCARATGCCNGGNAARGGNYTNGARTGGATGGGN

SEQ ID NO: 996 - protein, 42 aa, Homo Sapiens
TGGATHMGNCARWSNCCNWSNMGNGGNYTNGARTGGYTNGGN

SEQ ID NO: 997 - protein, 96 aa, Homo Sapiens
MGNGTNCANATGCANCANGAYCANWSNCANWSNCANGCNTAYATGGARYTNMGNWSNYTNMGNWSNGAYGAYCANGCNGTNTAYTAYTGYGCNMGN

SEQ ID NO: 998 - protein, 96 aa, Homo Sapiens
MGNGTNCANATGCANMGNGAYCANWSNATHWSNCANGCNTAYATGGARYTNWSNMGNYTNMGNWSNGAYGAYCANGCNGTNTAYTAYTGYGCNMGN

SEQ ID NO: 999 - protein, 96 aa, Homo Sapiens
MGNGTNCANATGYTNGARGAYCANWSNCANGAYCANGCNTAYATGGARYTNWSNWSNYTNMGNWSNGARGAYCANGCNGTNTAYTAYTGYGCNCAN

SEQ ID NO: 1000 - protein, 96 aa, Homo Sapiens
MGNYTNCANATHWSNAARGAYCANWSNAARWSNCARGTNGTNYTNCANATGCANAAYATGGAYCCNGTNGAYCANGCNCANTAYTAYTGYGCNMGN

SEQ ID NO: 1001 - protein, 96 aa, Homo Sapiens
MGNYTNCANATHCANAARGAYCANWSNAARAAYCARGTNGTNYTNCANATGCANAAYATGGAYCCNGTNGAYCANGCNCANTAYTAYTGYGCNCAY

SEQ ID NO: 1002 - protein, 96 aa, Homo Sapiens
MGNYTNCANATHCANAARGAYCANWSNAARCANCARGTNGTNYTNCANGTNCANGAYATGGAYCCNGTNGAYCANGCNCANTAYTAYTGYGCNCAY

SEQ ID NO: 1003 - protein, 96 aa, Homo Sapiens
MGNYTNCANATHCANAARGAYCANWSNAARAAYCARGTNGTNYTNCANATGCANAAYYTNGAYCCNGTNGAYCANGCNCANTAYTAYTGYGCNCAY

SEQ ID NO: 1004 - protein, 96 aa, Homo Sapiens
MGNYTNCANATHCANAARGCNCANWSNAARAAYCARGTNGTNYTNCANATGCANAAYATGGAYCCNGTNGAYCANGCNCANTAYTAYTGYGCNCAY

SEQ ID NO: 1005 - protein, 96 aa, Homo Sapiens
MGNTTYCANATHWSNMGNGAYAAYGCNAARAAYWSNYTNTAYYTNCARATGAAYWSNYTNMGNGCNGARGAYCANGCNGTNTAYTAYTGYGCNMGN

SEQ ID NO: 1006 - protein, 96 aa, Homo Sapiens
MGNTTYCANATHWSNMGNGAYAAYWSNAARAAYCANYTNTAYYTNCARATGAAYWSNYTNMGNGCNGARGAYCANGCNGTNTAYTAYTGYGCNAAR

SEQ ID NO: 1007 - protein, 96 aa, Homo Sapiens
MGNTTYCANATHWSNMGNGAYAAYWSNAARAAYCANYTNTAYYTNCARATGAAYWSNYTNMGNGCNGARGAYCANGCNGARTAYTAYTGYGCNAAR

SEQ ID NO: 1008 - protein, 96 aa, Homo Sapiens
MGNTTYCANATHWSNMGNGAYAAYWSNATGAAYCANYTNTAYYTNCARATGAAYWSNYTNMGNGCNGARGAYCANGCNGTNTAYTAYTGYGCNMGN

SEQ ID NO: 1009 - protein, 96 aa, Homo Sapiens
MGNTTYCANATHWSNMGNGAYAAYWSNAARAAYCANYTNTAYYTNCARATGAAYWSNYTNMGNGCNGARGAYCANGCNGTNTAYTAYTGYGCNMGN

SEQ ID NO: 1010 - protein, 96 aa, Homo Sapiens
MGNTTYCANATHWSNMGNGAYAAYWSNAARAAYCANYTNTAYYTNCARATGAAYWSNYTNMGNGCNGARGAYCANGCNGTNTAYTAYTGYGTNYTN

SEQ ID NO: 1011 - protein, 96 aa, Homo Sapiens
MGNTTYCANATHWSNMGNGAYAAYWSNAARAAYCANYTNGAYYTNCARATGAAYWSNYTNMGNGCNGARGAYCANGCNGTNTAYTAYTGYGCNMGN

SEQ ID NO: 1012 - protein, 96 aa, Homo Sapiens
MGNTTYCANATHWSNMGNGAYAAYGCNAARAAYWSNYTNTTYYTNCARATGAAYWSNYTNMGNGAYGARGAYCANGCNGTNTAYTAYTGYGCNYTN

SEQ ID NO: 1013 - protein, 96 aa, Homo Sapiens
MGNTTYCANATHWSNMGNGAYAAYGCNAARAAYWSNGTNTAYYTNCARATGAAYWSNYTNMGNGAYGARGAYCANGCNGTNTAYTAYTGYGCNMGN

SEQ ID NO: 1014 - protein, 96 aa, Homo Sapiens
MGNTTYCANATHWSNMGNGAYAAYGCNAARAAYWSNYTNTAYYTNCARATGAAYWSNYTNMGNGAYGARGAYCANGCNGTNTAYTAYTGYGCNMGN

SEQ ID NO: 1015 - protein, 96 aa, Homo Sapiens
MGNGTNCANATHWSNGTNGAYCANWSNAARAAYCARTTYWSNYTNAAYYTNWSNWSNGTNCANGCNGCNGAYCANGCNGTNTAYTAYTGYGCNMGN

SEQ ID NO: 1016 - protein, 96 aa, Homo Sapiens
MGNGTNAAYATGWSNGTNGAYCANWSNAARAAYCARTTYWSNYTNAARYTNWSNWSNGTNCANGCNGCNGAYCANGCNGTNTAYTAYTGYGCNMGN

SEQ ID NO: 1017 - protein, 96 aa, Homo Sapiens
MGNGTNCANATHWSNGTNGAYCANWSNAARAAYCARTTYWSNYTNAARYTNWSNWSNGTNCANGCNGCNGAYCANGCNGTNTAYTAYTGYGCNMGN

SEQ ID NO: 1018 - protein, 96 aa, Homo Sapiens
MGNATHCANATHWSNGCNGAYCANWSNAARAAYCARTTYWSNYTNAARYTNAAYWSNGTNCANGCNGCNGAYCANGCNGTNTAYTAYTGYGCNMGN

SEQ ID NO: 1019 - protein, 96 aa, Homo Sapiens
MGNATHCANAARWSNGTNGAYCANWSNAARAAYCARTTYWSNYTNAARYTNWSNWSNGTNCANGCNGCNGAYCANGCNGTNTAYTAYTGYGCNMGN

SEQ ID NO: 1020 - protein, 96 aa, Homo Sapiens
MGNGTNCANATHWSNGTNGAYCANWSNAARAAYCARTTYWSNYTNAARYTNWSNWSNGTNCANGCNGCNGAYCANGCNGTNTAYTAYTGYGCNWSN

SEQ ID NO: 1021 - protein, 96 aa, Homo Sapiens
MGNGTNCANATHWSNGTNGAYCANWSNAARAAYCARTTYWSNYTNAARYTNTTYWSNGTNCANGCNGCNGAYCANGCNGTNTAYTTYTGYGCNMGN

SEQ ID NO: 1022 - protein, 96 aa, Homo Sapiens
MGNGTNCANATGWSNGTNGAYCANWSNAARAAYCARTTYWSNYTNAARYTNWSNWSNGTNCANGCNGCNGAYCANGCNGTNTAYTAYTGYGCNMGN

SEQ ID NO: 1023 - protein, 96 aa, Homo Sapiens
MGNGTNCANATHWSNATHGTNCANWSNMGNAAYCARTTYWSNYTNAARYTNWSNWSNGTNCANGCNGCNGAYCANGCNGTNTAYTAYTGYGCNMGN

SEQ ID NO: 1024 - protein, 96 aa, Homo Sapiens
CARGTNCANATHWSNGCNGAYAARWSNATHWSNCANGCNTAYYTNCARTGGWSNWSNYTNAARGCNWSNGAYCANGCNATGTAYTAYTGYGCNMGN

SEQ ID NO: 1025 - protein, 96 aa, Homo Sapiens
CARGTNCANATHWSNGCNGAYAARWSNATHAAYCANGCNTAYYTNCARTGGWSNWSNYTNAARGCNWSNGAYCANGCNATGTAYTAYTGYGCNMGN

SEQ ID NO: 1026 - protein, 96 aa, Homo Sapiens
MGNATHCANATHAAYCCNGAYCANWSNAARAAYCARTTYWSNYTNCARYTNAAYWSNGTNCANCCNGARGAYCANGCNGTNTAYTAYTGYGCNMGN

SEQ ID NO: 1027 - protein, 33 aa, Homo Sapiens
TGGGGNCARGGNCANYTNGTNCANGTNWSNWSN

SEQ ID NO: 1028 - protein, 33 aa, Homo Sapiens
TGGGGNCARGGNCANCANGTNCANGTNWSNWSN

SEQ ID NO: 1029 - protein, 33 aa, Homo Sapiens
TGGGGNCARGGNCANATGGTNCANGTNWSNWSN

SEQ ID NO: 1030 - protein, 33 aa, Homo Sapiens
TGGGGNCARGGNWSNYTNGTNCANGTNWSNCCN

SEQ ID NO: 1031 - protein, 33 aa, Homo Sapiens
TGGGGNCARGGNCANAARGTNCANGTNWSNWSN

SEQ ID NO: 1032 - protein, 33 aa, Homo Sapiens
TGGGGNMGNGGNCANYTNGTNCANGTNWSNWSN

SEQ ID NO: 1033 - protein, 16 aa, Homo sapiens
  MISC_FEATURE (1)..(1): X1 is selected from the group consisting of H and LI
XIFSNDEKSYSTSLKS

SEQ ID NO: 1034 - protein, 16 aa, Homo sapiens
  MISC_FEATURE (6)..(6): X1 is selected from the group consisting of D and V
  MISC_FEATURE (7)..(7): X2 is selected from the group consisting of D and E
  MISC_FEATURE (15)..(15): X3 is selected from the group consisting of K and R
LIYWNXXKRYSPSLXS

SEQ ID NO: 1035 - protein, 13 aa, Homo sapiens
  MISC_FEATURE (1)..(1): X1 is selected from the group consisting of E and S
  MISC_FEATURE (2)..(2): X2 is selected from the group consisting of D, G and no amino acid
  MISC_FEATURE (3)..(3): X3 is selected from the group consisting of D, N and no amino acid
  MISC_FEATURE (4)..(4): X4 is selected from the group consisting of G and no amino acid
  MISC_FEATURE (5)..(5): X5 is selected from the group consisting of G and no amino acid
  MISC_FEATURE (6)..(6): X6 is selected from the group consisting of W, Y and no amino acid
  MISC_FEATURE (7)..(7): X7 is selected from the group consisting of I, N and Y
  MISC_FEATURE (8)..(8): X8 is selected from the group consisting of A and Y
  MISC_FEATURE (9)..(9): X9 is selected from the group consisting of G, V and Y
  MISC_FEATURE (10)..(10): X10 is selected from the group consisting of A, F and G
  MISC_FEATURE (11)..(11): X11 is selected from the group consisting of F, L and M
  MISC_FEATURE (13)..(13): X12 is selected from the group consisting of V and Y
XXXXXXXXXXXDX

SEQ ID NO: 1036 - protein, 18 aa, Homo sapiens
  MISC_FEATURE (2)..(2): X1 is selected from the group consisting of G and no amino acid
  MISC_FEATURE (3)..(3): X2 is selected from the group consisting of K, L and Y
  MISC_FEATURE (4)..(4): X3 is selected from the group consisting of A, G and S
  MISC_FEATURE (5)..(5): X4 is selected from the group consisting of S, V and Y
  MISC_FEATURE (6)..(6): X5 is selected from the group consisting of A and G
  MISC_FEATURE (7)..(7): X6 is selected from the group consisting of G and no amino acid
  MISC_FEATURE (8)..(8): X7 is selected from the group consisting of T and no amino acid
  MISC_FEATURE (9)..(9): X8 is selected from the group consisting of S and no amino acid
  MISC_FEATURE (10)..(10): X9 is selected from the group consisting of Y and no amino acid
  MISC_FEATURE (11)..(11): X10 is selected from the group consisting of W and Y
  MISC_FEATURE (12)..(12): X11 is selected from the group consisting of G, S and Y
  MISC_FEATURE (14)..(14): X12 is selected from the group consisting of F and Y
  MISC_FEATURE (15)..(15): X13 is selected from the group consisting of G and no amino acid
  MISC_FEATURE (16)..(16): X14 is selected from the group consisting of M and no amino acid
  MISC_FEATURE (18)..(18): X15 is selected from the group consisting of V and Y
QXXXXXXXXXXXYXXXDX

SEQ ID NO: 1037 - protein, 14 aa, Homo sapiens
  MISC_FEATURE (1)..(1): X1 is selected from the group consisting of D, G, L, S and no amino acid
  MISC_FEATURE (2)..(2): X2 is selected from the group consisting of G, H, W, Y and no amino acid
  MISC_FEATURE (3)..(3): X3 is selected from the group consisting of A, F, W, Y and no amino acid
  MISC_FEATURE (4)..(4): X4 is selected from the group consisting of D, G, Q, T and no amino acid
  MISC_FEATURE (5)..(5): X5 is selected from the group consisting of G, I, Q, S and no amino acid
  MISC_FEATURE (6)..(6): X6 is selected from the group consisting of A, D, N, Q, S and no amino acid
  MISC_FEATURE (7)..(7): X7 is selected from the group consisting of G, Y and no amino acid
  MISC_FEATURE (8)..(8): X8 is selected from the group consisting of D, Y and no amino acid
  MISC_FEATURE (9)..(9): X9 is selected from the group consisting of Y and no amino acid
  MISC_FEATURE (10)..(10): X10 is selected from the group consisting of A, E, N and Y
  MISC_FEATURE (11)..(11): X11 is selected from the group consisting of G, P, T, V and Y
  MISC_FEATURE (12)..(12): X12 is selected from the group consisting of F and I
  MISC_FEATURE (13)..(13): X13 is selected from the group consisting of D and Q
  MISC_FEATURE (14)..(14): X14 is selected from the group consisting of C, H, V and Y
XXXXXXXXXXXXXX

SEQ ID NO: 1038 - protein, 19 aa, Homo sapiens
  MISC_FEATURE (1)..(1): X1 is selected from the group consisting of E, D and no amino acid
  MISC_FEATURE (2)..(2): X2 is selected from the group consisting of G, R and no amino acid
  MISC_FEATURE (3)..(3): X3 is selected from the group consisting of I, V, Y and no amino acid
  MISC_FEATURE (4)..(4): X4 is selected from the group consisting of A, G, L and N
  MISC_FEATURE (5)..(5): X5 is selected from the group consisting of A, G, V and W
  MISC_FEATURE (6)..(6): X6 is selected from the group consisting of A, N, R and T
  MISC_FEATURE (7)..(7): X7 is selected from the group consisting of G, N, P and no amino acid
  MISC_FEATURE (8)..(8): X8 is selected from the group consisting of G, T and no amino acid
  MISC_FEATURE (9)..(9): X9 is selected from the group consisting of A and no amino acid
  MISC_FEATURE (10)..(10): X10 is selected from the group consisting of D, E and no amino acid
  MISC_FEATURE (11)..(11): X11 is selected from the group consisting of S, Y and no amino acid
  MISC_FEATURE (12)..(12): X12 is selected from the group consisting of G, Y and no amino acid
  MISC_FEATURE (13)..(13): X13 is selected from the group consisting of N, Y and no amino acid
  MISC_FEATURE (14)..(14): X14 is selected from the group consisting of Y and no amino acid
  MISC_FEATURE (15)..(15): X15 is selected from the group consisting of D, Y and no amino acid
  MISC_FEATURE (16)..(16): X16 is selected from the group consisting of A, G and no amino acid
  MISC_FEATURE (17)..(17): X17 is selected from the group consisting of F and M
  MISC_FEATURE (19)..(19): X18 is selected from the group consisting of I, V and Y
XXXXXXXXXXXXXXXXXDX

SEQ ID NO: 1039 - protein, 23 aa, Homo sapiens
  MISC_FEATURE (1)..(1): X1 is selected from the group consisting of A, D, G, S and T
  MISC_FEATURE (2)..(2): X2 is selected from the group consisting of A, E, G, L, N, R, Y and no amino acid
  MISC_FEATURE (3)..(3): X3 is selected from the group consisting of A, G, L, N, R, T, Y and no amino acid
  MISC_FEATURE (4)..(4): X4 is selected from the group consisting of D, G, R, S, V, Y and no amino acid
  MISC_FEATURE (5)..(5): X5 is selected from the group consisting of A, G, I, S, V, Y and no amino acid
  MISC_FEATURE (6)..(6): X6 is selected from the group consisting of F, G, L, R, V and no amino acid
  MISC_FEATURE (7)..(7): X7 is selected from the group consisting of L, T, Y and no amino acid
  MISC_FEATURE (8)..(8): X8 is selected from the group consisting of Y and no amino acid
  MISC_FEATURE (9)..(9): X9 is selected from the group consisting of Y and no amino acid
  MISC_FEATURE (10)..(10): X10 is selected from the group consisting of D and no amino acid
  MISC_FEATURE (11)..(11): X11 is selected from the group consisting of S and no amino acid
  MISC_FEATURE (12)..(12): X12 is selected from the group consisting of S and no amino acid
  MISC_FEATURE (13)..(13): X13 is selected from the group consisting of G and no amino acid
  MISC_FEATURE (14)..(14): X14 is selected from the group consisting of D, L, M, S, Y and no amino acid
  MISC_FEATURE (15)..(15): X15 is selected from the group consisting of H, I, P, V, W and no amino acid
  MISC_FEATURE (16)..(16): X16 is selected from the group consisting of F, G, L, R, S, Y and no amino acid
  MISC_FEATURE (17)..(17): X17 is selected from the group consisting of D, F, V, W, Y and no amino acid
  MISC_FEATURE (18)..(18): X18 is selected from the group consisting of C, F, L, P, S and Y
  MISC_FEATURE (19)..(19): X19 is selected from the group consisting of D, F, G and Y
  MISC_FEATURE (20)..(20): X20 is selected from the group consisting of A, C, G, P, R, V and Y
  MISC_FEATURE (21)..(21): X21 is selected from the group consisting of F, L, M, S and no amino acid
  MISC_FEATURE (22)..(22): X22 is selected from the group consisting of A, D and no amino acid
  MISC_FEATURE (23)..(23): X23 is selected from the group consisting of I, L, V, Y and no amino acid
XXXXXXXXXXXXXXXXXXXXXXX

SEQ ID NO: 1040 - protein, 14 aa, Homo sapiens
  MISC_FEATURE (1)..(1): X1 is selected from the group consisting of M and V
  MISC_FEATURE (7)..(7): X2 is selected from the group consisting of S and no amino acid
  MISC_FEATURE (8)..(8): X3 is selected from the group consisting of F and no amino acid
  MISC_FEATURE (11)..(11): X4 is selected from the group consisting of V and no amino acid
  MISC_FEATURE (12)..(12): X5 is selected from the group consisting of F and M
  MISC_FEATURE (14)..(14): X6 is selected from the group consisting of V and Y
XYSSGWXXYGXXDX

SEQ ID NO: 1041 - protein, 8 aa, Homo sapiens
  MISC_FEATURE (2)..(2): X1 is selected from the group consisting of G, H, L, N and R
  MISC_FEATURE (3)..(3): X2 is selected from the group consisting of E, T and W
  MISC_FEATURE (4)..(4): X3 is selected from the group consisting of L, N, T and V
  MISC_FEATURE (7)..(7): X4 is selected from the group consisting of D and E
RXXXPFXY

SEQ ID NO: 1042 - protein, 208 aa, Homo sapiens
MKLLPSVVLKLFLAAVLSALVTGESLERLRRGLAAGTSNPDPPTVSTDQLLPLGGGRDRKVRDLQEADLDLLRVTLSSKPQALATPNKEEHGKRKKKGKGLGKKRDPCLRKYKDFCIHGECKYVKELRAPSCICHPGYHGERCHGLSLPVENRLYTYDHTTILAVVAVVLSSVCLLVIVGLLMFRYHRRGGYDVENEEKVKLGMTNSH

SEQ ID NO: 1043 - protein, 19 aa, Homo sapiens
MKLLPSVVLKLFLAAVLSA

SEQ ID NO: 1044 - protein, 149 aa, Homo sapiens
MKLLPSVVLKLFLAAVLSALVTGESLERLRRGLAAGTSNPDPPTVSTDQLLPLGGGRDRKVRDLQEADLDLLRVTLSSKPQALATPNKEEHGKRKKKGKGLGKKRDPCLRKYKDFCIHGECKYVKELRAPSCICHPGYHGERCHGLSLP

SEQ ID NO: 1045 - protein, 87 aa, Homo sapiens
DLQEADLDLLRVTLSSKPQALATPNKEEHGKRKKKGKGLGKKRDPCLRKYKDFCIHGECKYVKELRAPSCICHPGYHGERCHGLSLP

SEQ ID NO: 1046 - protein, 43 aa, Homo sapiens
PCLRKYKDFCIHGECKYVKELRAPSCICHPGYHGERCHGLSLP

SEQ ID NO: 1047 - protein, 149 aa, Homo sapiens; identical to SEQ ID NO: 1044

SEQ ID NO: 1048 - DNA, 32 bp, Artificial
  forward primer
gggttaacgccaccatgaagctgctgccgtcg

SEQ ID NO: 1049 - DNA, 28 bp, Artificial
  reverse primer
ccgctcgaggtgggaattagtcatgccc

SEQ ID NO: 1050 - DNA, 31 bp, Artificial
  forward primer
ggaattcgccaccatgaagctgctgccgtcg

SEQ ID NO: 1051 - DNA, 30 bp, Artificial
  reverse primer
ccgctcgaggtgggagctagcagccacgcc

SEQ ID NO: 1052 - protein, 44 aa, Homo sapiens
DPCLRKYKDFCIHGECKYVKELRAPSCICHPGYHGERCHGLSLP

SEQ ID NO: 1053 - protein, 49 aa, Homo sapiens
LGKKRDPCLRKYKDYCIHGECKYVKELRAPSCICHPGYHGERCHGLSLP

SEQ ID NO: 1054 - protein, 49 aa, Homo sapiens
LGKKRDPCLRKYKDFCIHGECKYVKEFRAPSCICHPGYHGERCHGLSLP

SEQ ID NO: 1055 - protein, 49 aa, Homo sapiens
LGKKRDPCLRKYKDFCIHGECKYVKELRAPSCICHPGYHGHRCHGLSLP

SEQ ID NO: 1056 - protein, 49 aa, Homo sapiens
LGKKRDPCLRKYKDFCIHGECRYLQELRAPSCICHPGYHGERCHGLSLP

SEQ ID NO: 1057 - protein, 49 aa, Homo sapiens
LGKKRDPCLRKYKDYCIHGECRYLQELRAPSCICHPGYHGERCHGLSLP

SEQ ID NO: 1058 - protein, 49 aa, Homo sapiens
LGKKRDPCLRKYKDFCIHGECRYLQELRAPSCICHPGYHGHRCHGLSLP

SEQ ID NO: 1059 - protein, 49 aa, Homo sapiens
LGKKRDPCLRKYKDFCIHGECKYVKELRAPSCKCLPGYHGERCHGLSLP

SEQ ID NO: 1060 - protein, 49 aa, Homo sapiens
LGKKRDPCLRKYKDYCIHGECKYVKELRAPSCKCLPGYHGERCHGLSLP

SEQ ID NO: 1061 - protein, 49 aa, Homo sapiens
LGKKRDPCLRKYKDFCIHGECKYVKEFRAPSCKCLPGYHGERCHGLSLP

SEQ ID NO: 1062 - protein, 49 aa, Homo sapiens
LGKKRDPCLRKYKDFCIHGECKYVKELRAPSCICHPGYHGERCHGLSTP

SEQ ID NO: 1063 - protein, 49 aa, Homo sapiens
LGKKRDPCLRKYKDFCIHGECKYVKELRAPSCICHPGYHGHRCHGLSTP

SEQ ID NO: 1064 - protein, 50 aa, Homo sapiens
LGKKRDPCLRKYKDFCLHDGVCKYVKELRAPSCICHPGYHGERCHGLSLP

SEQ ID NO: 1065 - protein, 214 aa, Homo Sapiens
DIQMTQSPSSLSASVGDRVTITCRASQSISSYLNWYQQKPGKAPKLLIYTASSLQSGVPSRFSGSGSGTDFTLTLSSLQPEDFASYYCQQSFYTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1066 - protein, 23 aa, Homo Sapiens
DIQMTQSPSSLSASVGDRVTITC

SEQ ID NO: 1067 - protein, 23 aa, Homo Sapiens
NIVMTQTPLSSPVTLGQPASISC

SEQ ID NO: 1068 - protein, 23 aa, Homo Sapiens
DIVMTQSPDSLTVSLGERATINC

SEQ ID NO: 1069 - protein, 23 aa, Homo Sapiens
DIQMTQSPSSLSASVGDGVTITC

SEQ ID NO: 1070 - protein, 23 aa, Homo Sapiens
DIQMTQSPSSLSASVGDRVAITC

SEQ ID NO: 1071 - protein, 23 aa, Homo Sapiens
DIQMTQSPSSLSASVGDRVTITC

SEQ ID NO: 1072 - protein, 23 aa, Homo Sapiens
DIQMTQSPSSRSASVGDRVTITC

SEQ ID NO: 1073 - protein, 23 aa, Homo Sapiens
DIQMTQSPSSVSASVGDRVTITC

SEQ ID NO: 1074 - protein, 15 aa, Homo Sapiens
WFQQRPGQSPRRLIY

SEQ ID NO: 1075 - protein, 32 aa, Homo Sapiens
RFTVSRDNSKNTLFLQMNSLRAEDTAVYYCAR

SEQ ID NO: 1076 - protein, 69 aa, Homo Sapiens; identical to SEQ ID NO: 897

SEQ ID NO: 1077 - protein, 69 aa, Homo Sapiens
GARATHGTNATGCANCARCANCCNYTNWSNWSNCCNGTNCANYTNGGNCARCCNGCNWSNATHWSNTGY

SEQ ID NO: 1078 - protein, 69 aa, Homo Sapiens; identical to SEQ ID NO: 898

SEQ ID NO: 1079 - protein, 69 aa, Homo Sapiens
GAYATHCARATGCANCARWSNCCNWSNWSNMGNWSNGCNWSNGTNGGNGAYMGNGTNCANATHCANTGY

SEQ ID NO: 1080 - protein, 69 aa, Homo Sapiens
GAYATHCARATGCANCARWSNCCNWSNWSNYTNWSNGCNWSNGTNGGNGAYGGNGTNCANATHCANTGY

SEQ ID NO: 1081 - protein, 69 aa, Homo Sapiens; identical to SEQ ID NO: 897

SEQ ID NO: 1082 - protein, 69 aa, Homo Sapiens; identical to SEQ ID NO: 902

SEQ ID NO: 1083 - protein, 69 aa, Homo Sapiens
GAYATHCARATGCANCARWSNCCNWSNWSNYTNWSNGCNWSNYTNGGNGAYMGNGTNCANATHCANTGY

SEQ ID NO: 1084 - protein, 45 aa, Homo Sapiens
TGGTTYCARCARMGNCCNGGNCARWSNCCNMGNMGNYTNATHTAY

SEQ ID NO: 1085 - protein, 75 aa, Homo Sapiens; identical to SEQ ID NO: 978

SEQ ID NO: 1086 - protein, 75 aa, Homo Sapiens
GARGTNCARYTNCARCARTGGGGNGCNGGNYTNYTNAARCCNWSNGARCANYTNWSNYTNCANTGYGCNGTNTAY

SEQ ID NO: 1087 - protein, 42 aa, Homo Sapiens; identical to SEQ ID NO: 989

SEQ ID NO: 1088 - protein, 96 aa, Homo Sapiens
MGNTTYCANGTNWSNMGNGAYAAYWSNAARAAYCANYTNTTYYTNCARATGAAYWSNYTNMGNGCNGARGAYCANGCNGTNTAYTAYTGYGCNMGN

SEQ ID NO: 1089 - protein, 9 aa, Homo sapiens
  MISC_FEATURE (1)..(1): X1 is selected from the group consisting of I and M
  MISC_FEATURE (3)..(3): X2 is selected from the group consisting of A, G and S
  MISC_FEATURE (4)..(4): X3 is selected from the group consisting of I and T
  MISC_FEATURE (5)..(5): X4 is selected from the group consisting of H and Q
  MISC_FEATURE (6)..(6): X5 is selected from the group consisting of F, L and W
  MISC_FEATURE (8)..(8): X6 is selected from the group consisting of C, I, H, L and T
  MISC_FEATURE (9)..(9): X7 is selected from the group consisting of S and T
XQXXXXPXX

SEQ ID NO: 1090 - protein, 9 aa, Homo sapiens
  MISC_FEATURE (3)..(3): X1 is selected from the group consisting of I and S
  MISC_FEATURE (4)..(4): X2 is selected from the group consisting of F and Y
  MISC_FEATURE (5)..(5): X3 is selected from the group consisting of F, I, S and Y
  MISC_FEATURE (6)..(6): X4 is selected from the group consisting of A, S and T
  MISC_FEATURE (7)..(7): X5 is selected from the group consisting of P and S
QQXXXXXIT

SEQ ID NO: 1091 - protein, 9 aa, Homo sapiens
  MISC_FEATURE (1)..(1): X1 is selected from the group consisting of L and Q
  MISC_FEATURE (2)..(2): X2 is selected from the group consisting of K, N and Q
  MISC_FEATURE (3)..(3): X3 is selected from the group consisting of A, H, S and Y
  MISC_FEATURE (4)..(4): X4 is selected from the group consisting of H, N and Y
  MISC_FEATURE (5)..(5): X5 is selected from the group consisting of N, S and T
  MISC_FEATURE (6)..(6): X6 is selected from the group consisting of A, F, I, T, V and Y
  MISC_FEATURE (7)..(7): X7 is selected from the group consisting of P and no amino acid
  MISC_FEATURE (8)..(8): X8 is selected from the group consisting of F, L and P
XXXXXXXXT

SEQ ID NO: 1092 - protein, 9 aa, Homo sapiens
  MISC_FEATURE (2)..(2): X1 is selected from the group consisting of H and Q
  MISC_FEATURE (3)..(3): X2 is selected from the group consisting of C and Y
  MISC_FEATURE (5)..(5): X3 is selected from the group consisting of D, I, N, S and Y
  MISC_FEATURE (8)..(8): X4 is selected from the group consisting of F, I and L
  MISC_FEATURE (9)..(9): X5 is selected from the group consisting of A, S and T
QXXDXLPXX

SEQ ID NO: 1093 - protein, 10 aa, Homo sapiens
  MISC_FEATURE (3)..(3): X1 is selected from the group consisting of H and Y
  MISC_FEATURE (4)..(4): X2 is selected from the group consisting of G and N
  MISC_FEATURE (5)..(5): X3 is selected from the group consisting of N and S
  MISC_FEATURE (6)..(6): X4 is selected from the group consisting of S and W
  MISC_FEATURE (8)..(8): X5 is selected from the group consisting of P and no amino acid
  MISC_FEATURE (9)..(9): X6 is selected from the group consisting of R and W
  MISC_FEATURE (10)..(10): X7 is selected from the group consisting of S and T
QQXXXXPXXX

SEQ ID NO: 1094 - protein, 10 aa, Homo sapiens
  MISC_FEATURE (1)..(1): X1 is selected from the group consisting of H and Q
  MISC_FEATURE (4)..(4): X2 is selected from the group consisting of F and Y
  MISC_FEATURE (5)..(5): X3 is selected from the group consisting of G, I and S
  MISC_FEATURE (6)..(6): X4 is selected from the group consisting of F, I and T
  MISC_FEATURE (7)..(7): X5 is selected from the group consisting of M, P, S and T
  MISC_FEATURE (8)..(8): X6 is selected from the group consisting of F, L, R and W
  MISC_FEATURE (9)..(9): X7 is selected from the group consisting of S and T
XQYXXXXXXF

SEQ ID NO: 1095 - protein, 10 aa, Homo sapiens
  MISC_FEATURE (4)..(4): X1 is selected from the group consisting of F and L
  MISC_FEATURE (6)..(6): X2 is selected from the group consisting of E, G and S
  MISC_FEATURE (7)..(7): X3 is selected from the group consisting of H, L and Y
  MISC_FEATURE (8)..(8): X4 is selected from the group consisting of G, S and Y
  MISC_FEATURE (9)..(9): X5 is selected from the group consisting of I and M
  MISC_FEATURE (10)..(10): X6 is selected from the group consisting of H and S
GYTXTXXXXX

SEQ ID NO: 1096 - protein, 10 aa, Homo sapiens
  MISC_FEATURE (3)..(3): X1 is selected from the group consisting of R and S
GYXFTSYWIG

SEQ ID NO: 1097 - protein, 10 aa, Homo sapiens
  MISC_FEATURE (5)..(5): X1 is selected from the group consisting of R and S
  MISC_FEATURE (7)..(7): X2 is selected from the group consisting of H and Y
  MISC_FEATURE (8)..(8): X3 is selected from the group consisting of D and G
GFTFXSXXMH

SEQ ID NO: 1098 - protein, 10 aa, Homo sapiens
  MISC_FEATURE (3)..(3): X1 is selected from the group consisting of P and T
  MISC_FEATURE (6)..(6): X2 is selected from the group consisting of A, R and S
  MISC_FEATURE (8)..(8): X3 is selected from the group consisting of A and S
  MISC_FEATURE (10)..(10): X4 is selected from the group consisting of N and S
GFXFSXYXMX

SEQ ID NO: 1099 - protein, 12 aa, Homo sapiens
  MISC_FEATURE (2)..(2): X1 is selected from the group consisting of D and G
  MISC_FEATURE (4)..(4): X2 is selected from the group consisting of F, I and V
  MISC_FEATURE (6)..(6): X3 is selected from the group consisting of R, S and no amino acid
  MISC_FEATURE (7)..(7): X4 is selected from the group consisting of G, Y and no amino acid
  MISC_FEATURE (8)..(8): X5 is selected from the group consisting of D, G, S and no amino acid
  MISC_FEATURE (9)..(9): X6 is selected from the group consisting of A, S and Y
  MISC_FEATURE (10)..(10): X7 is selected from the group consisting of A and Y
  MISC_FEATURE (12)..(12): X8 is selected from the group consisting of N and S
GXSXSXXXXXWX

SEQ ID NO: 1100 - protein, 12 aa, Homo sapiens
  MISC_FEATURE (5)..(5): X1 is selected from the group consisting of S and N
GFSLXTGGVGVG

SEQ ID NO: 1101 - protein, 16 aa, Homo sapiens
  MISC_FEATURE (1)..(1): X1 is selected from the group consisting of S and W
  MISC_FEATURE (2)..(2): X2 is selected from the group consisting of F and I
  MISC_FEATURE (3)..(3): X3 is selected from the group consisting of D, N and S
  MISC_FEATURE (4)..(4): X4 is selected from the group consisting of A and P
  MISC_FEATURE (5)..(5): X5 is selected from the group consisting of E, N and S
  MISC_FEATURE (6)..(6): X6 is selected from the group consisting of D, N and S
  MISC_FEATURE (8)..(8): X7 is selected from the group consisting of E, G and N
  MISC_FEATURE (10)..(10): X8 is selected from the group consisting of I and N
  MISC_FEATURE (11)..(11): X9 is selected from the group consisting of C, H and Y
  MISC_FEATURE (12)..(12): X10 is selected from the group consisting of A and T
  MISC_FEATURE (15)..(15): X11 is selected from the group consisting of F and L
  MISC_FEATURE (16)..(16): X12 is selected from the group consisting of D and G
XXXXXXGXTXXXQKXX

SEQ ID NO: 1102 - protein, 17 aa, Homo sapiens
  MISC_FEATURE (5)..(5): X1 is selected from the group consisting of D and G
  MISC_FEATURE (9)..(9): X2 is selected from the group consisting of A, I and T
IIYPXDSDXRYSPSFQG

SEQ ID NO: 1103 - protein, 17 aa, Homo sapiens
  MISC_FEATURE (1)..(1): X1 is selected from the group consisting of F and V
  MISC_FEATURE (3)..(3): X2 is selected from the group consisting of S and W
  MISC_FEATURE (4)..(4): X3 is selected from the group consisting of D, S and Y
  MISC_FEATURE (8)..(8): X4 is selected from the group consisting of I, N and T
  MISC_FEATURE (9)..(9): X5 is selected from the group consisting of K and Q
  MISC_FEATURE (10)..(10): X6 is selected from the group consisting of N, R and Y
  MISC_FEATURE (12)..(12): X7 is selected from the group consisting of A, T and V
  MISC_FEATURE (16)..(16): X8 is selected from the group consisting of K and R
XIXXDGSXXXYXDSVXG

SEQ ID NO: 1104 - protein, 17 aa, Homo sapiens
  MISC_FEATURE (1)..(1): X1 is selected from the group consisting of A, H and Y
  MISC_FEATURE (4)..(4): X2 is selected from the group consisting of G, R and S
  MISC_FEATURE (6)..(6): X3 is selected from the group consisting of G and S
  MISC_FEATURE (7)..(7): X4 is selected from the group consisting of G, R and S
  MISC_FEATURE (8)..(8): X5 is selected from the group consisting of S, T and Y
  MISC_FEATURE (9)..(9): X6 is selected from the group consisting of I and T
XISXSXXXXYYADSVKG

SEQ ID NO: 1105 - protein, 18 aa, Homo sapiens
  MISC_FEATURE (1)..(1): X1 is selected from the group consisting of E, R and Y
  MISC_FEATURE (2)..(2): X2 is selected from the group consisting of I and T
  MISC_FEATURE (3)..(3): X3 is selected from the group consisting of H, N and Y
  MISC_FEATURE (4)..(4): X4 is selected from the group consisting of C, H, S, T and Y
  MISC_FEATURE (5)..(5): X5 is selected from the group consisting of S and R
  MISC_FEATURE (6)..(6): X6 is selected from the group consisting of G and S
  MISC_FEATURE (7)..(7): X7 is selected from the group consisting of G, K, S and T
  MISC_FEATURE (8)..(8): X8 is selected from the group consisting of T and W
  MISC_FEATURE (9)..(9): X9 is selected from the group consisting of N and Y
  MISC_FEATURE (10)..(10): X10 is selected from the group consisting of N and no amino acid
  MISC_FEATURE (11)..(11): X11 is selected from the group consisting of D and no amino acid
  MISC_FEATURE (13)..(13): X12 is selected from the group consisting of A and N
  MISC_FEATURE (14)..(14): X13 is selected from the group consisting of P and V
  MISC_FEATURE (16)..(16): X14 is selected from the group consisting of L and V
XXXXXXXXXXXYXXSXKS

SEQ ID NO: 1106 - protein, 16 aa, Homo sapiens
  MISC_FEATURE (1)..(1): X1 is selected from the group consisting of K and R
  MISC_FEATURE (7)..(7): X2 is selected from the group consisting of L and V
  MISC_FEATURE (8)..(8): X3 is selected from the group consisting of H and Y
  MISC_FEATURE (12)..(12): X4 is selected from the group consisting of K and N
  MISC_FEATURE (16)..(16): X5 is selected from the group consisting of N, S and Y
XSSQSLXXSDGXTYLX

SEQ ID NO: 1107 - protein, 11 aa, Homo sapiens
  MISC_FEATURE (5)..(5): X1 is selected from the group consisting of R, S and T
  MISC_FEATURE (8)..(8): X2 is selected from the group consisting of R and S
RASQXISXYLN

SEQ ID NO: 1108 - protein, 11 aa, Homo sapiens
  MISC_FEATURE (5)..(5): X1 is selected from the group consisting of D, G, S and T
  MISC_FEATURE (7)..(7): X2 is selected from the group consisting of A, R and S
  MISC_FEATURE (8)..(8): X3 is selected from the group consisting of H, I, N, R, S and T
  MISC_FEATURE (9)..(9): X4 is selected from the group consisting of D, W and Y
  MISC_FEATURE (11)..(11): X5 is selected from the group consisting of A, G and N
RASQXIXXXLX

SEQ ID NO: 1109 - protein, 11 aa, Homo sapiens
  MISC_FEATURE (7)..(7): X1 is selected from the group consisting of S and T
  MISC_FEATURE (8)..(8): X2 is selected from the group consisting of D and N
  MISC_FEATURE (9)..(9): X3 is selected from the group consisting of S and Y
QASQDIXXXLN

SEQ ID NO: 1110 - protein, 12 aa, Homo sapiens
  MISC_FEATURE (5)..(5): X1 is selected from the group consisting of S and T
  MISC_FEATURE (7)..(7): X2 is selected from the group consisting of I and S
  MISC_FEATURE (8)..(8): X3 is selected from the group consisting of R and S
  MISC_FEATURE (9)..(9): X4 is selected from the group consisting of S, N and no amino acid
  MISC_FEATURE (10)..(10): X5 is selected from the group consisting of Y and no amino acid
RASQXVXXXXLA

SEQ ID NO: 1111 - protein, 17 aa, Homo sapiens
  MISC_FEATURE (5)..(5): X1 is selected from the group consisting of N and S
  MISC_FEATURE (6)..(6): X2 is selected from the group consisting of I and V
  MISC_FEATURE (8)..(8): X3 is selected from the group consisting of D and Y
  MISC_FEATURE (9)..(9): X4 is selected from the group consisting of N, R and S
  MISC_FEATURE (17)..(17): X5 is selected from the group consisting of A and V
KSSQXXLXXSNNKNYLX

SEQ ID NO: 1112 - protein, 7 aa, Homo sapiens
  MISC_FEATURE (1)..(1): X1 is selected from the group consisting of E and K
  MISC_FEATURE (2)..(2): X2 is selected from the group consisting of I and V
  MISC_FEATURE (5)..(5): X3 is selected from the group consisting of R and W
  MISC_FEATURE (6)..(6): X4 is selected from the group consisting of D and F
XXSNXXS

SEQ ID NO: 1113 - protein, 7 aa, Homo sapiens
  MISC_FEATURE (1)..(1): X1 is selected from the group consisting of A and T
  MISC_FEATURE (2)..(2): X2 is selected from the group consisting of A, E and V
  MISC_FEATURE (4)..(4): X3 is selected from the group consisting of S and T
XXSXLQS

SEQ ID NO: 1114 - protein, 7 aa, Homo sapiens
  MISC_FEATURE (1)..(1): X1 is selected from the group consisting of A and V
  MISC_FEATURE (4)..(4): X2 is selected from the group consisting of S and T
XASXLQS

SEQ ID NO: 1115 - protein, 7 aa, Homo sapiens
  MISC_FEATURE (4)..(4): X1 is selected from the group consisting of I and N
DASXLET

SEQ ID NO: 1116 - protein, 7 aa, Homo sapiens
  MISC_FEATURE (4)..(4): X1 is selected from the group consisting of A and T
WASXRES

The invention claimed is:

1. An isolated antigen binding protein that binds HB-EGF comprising
   a) an antibody light chain variable region, or antigen binding fragment thereof, comprising the CDRL1 of SEQ ID NO: 207, the CDRL2 of SEQ ID NO: 225, and the CDRL3 of SEQ ID NO: 257, and
   b) an antibody heavy chain variable region, or antigen binding fragment thereof, comprising the CDRH1 of SEQ ID NO: 292, the CDRH2 of SEQ ID NO: 323, and the CDRH3 of SEQ ID NO: 361.

2. The isolated antigen binding protein of claim 1, wherein the light chain variable region comprises SEQ ID NO: 121.

3. The isolated antigen binding protein of claim 1, wherein the heavy chain variable region comprises SEQ ID NO: 172.

4. The isolated antigen binding protein of claim 1, wherein the light chain variable region comprises SEQ ID NO: 121 and the heavy chain variable region comprises SEQ ID NO: 172.

5. The isolated antigen binding protein of claim 1 that is a single chain antibody.

6. An isolated nucleic acid molecule encoding the single chain antibody of claim 5.

7. An isolated nucleic acid molecule encoding both the light chain variable region and the heavy chain variable region of the antigen binding protein of claim 1.

8. A composition comprising a first isolated nucleic acid molecule encoding a light chain variable region and a second isolated nucleic acid molecule encoding a heavy chain variable region, wherein the light and heavy chain variable regions correspond to those of the antigen binding protein of claim 1.

9. A pharmaceutical composition comprising the antigen binding protein of claim 1, and a pharmaceutically acceptable carrier, diluent, and/or adjuvant.

10. A kit comprising the antigen binding protein of claim 1 and an anti-neoplastic agent.

* * * * *